United States Patent
Berti et al.

(10) Patent No.: US 10,245,310 B2
(45) Date of Patent: Apr. 2, 2019

(54) CARRIER MOLECULE FOR ANTIGENS

(71) Applicant: GLAXOSMITHKLINE BIOLOGICALS SA, Rixensart (BE)

(72) Inventors: Francesco Berti, Siena (IT); Roberta Cozzi, Siena (IT); Domenico Maione, Siena (IT); Cira Daniela Rinaudo, Siena (IT); Immaculada Margarit Y Ros, Siena (IT); Guido Grandi, Siena (IT)

(73) Assignee: GlaxoSmithKline Biologicals SA, Rixensart (BE)

( * ) Notice: Subject to any disclaimer, the term of this patent is extended or adjusted under 35 U.S.C. 154(b) by 0 days.

(21) Appl. No.: 15/501,474

(22) PCT Filed: Aug. 5, 2015

(86) PCT No.: PCT/EP2015/068012
§ 371 (c)(1),
(2) Date: Feb. 3, 2017

(87) PCT Pub. No.: WO2016/020413
PCT Pub. Date: Feb. 11, 2016

(65) Prior Publication Data
US 2017/0224803 A1    Aug. 10, 2017

(30) Foreign Application Priority Data
Aug. 5, 2014    (EP) .................................... 14179945

(51) Int. Cl.
*A61K 39/09*    (2006.01)
*A61K 39/095*    (2006.01)
*A61K 47/48*    (2006.01)

(52) U.S. Cl.
CPC ............ *A61K 39/092* (2013.01); *A61K 39/09* (2013.01); *A61K 39/095* (2013.01); *A61K 47/48* (2013.01)

(58) Field of Classification Search
None
See application file for complete search history.

(56) References Cited

U.S. PATENT DOCUMENTS

2009/0176311 A1* 7/2009 Berti ...................... A61K 39/00
436/94
2013/0071416 A1* 3/2013 Grandi ................. A61K 39/092
424/185.1

FOREIGN PATENT DOCUMENTS

| GB | 2478203 A | 8/2011 |
|----|-----------|--------|
| WO | 2006/069200 A2 | 6/2006 |
| WO | 2006/078318 A2 | 7/2006 |
| WO | 2009/027768 A2 | 3/2009 |
| WO | 2009/101403 A1 | 8/2009 |
| WO | 2010/079464 A1 | 7/2010 |
| WO | 2011/121576 A2 | 10/2011 |
| WO | 2013/030783 A1 | 3/2013 |
| WO | 2013/124473 A1 | 8/2013 |

OTHER PUBLICATIONS

Madoff, et al., Maternal Immunization of Mice with Group B Streptococcal Type III Polysaccharide-Beta C Protein Conjugate Elicits Protective Antibody to Multiple Serotypes, J Clin Invest (1994), 94(1): 286-292.
Cheng, et al., Antibody against Surface-Bound C5a Peptidase is Opsonic and Initiates Macrophage Killing of Group B Streptococci (2001), 69(4): 2302-2308.
Paoletti, et al., Vaccines to prevent neonatal GBS infection, Seminars in Neonatology (2002), 7(4): 315-323.
Fluegge, et al., Identification and immunoreactivity of proteins released from *Streptococcus agalactiae*, Eur J Microbiol Infect Dis (2004), 23(11): 818-824.
Lindahl, et al., Surface Proteins of *Streptococcus agalactiae* and Related Proteins in Other Bacterial Pathogens, Clin Microbiol Rev (2005), 18(1): 102-127.
Brzychczy-Wloch, et al., Identification of high immunoreactive proteins from *Streptococcus agalactiae* isolates recognized by human serum antibodies, FEMS Microbiology Letters (2013), 349: 61-70.

\* cited by examiner

*Primary Examiner* — Oluwatosin A Ogunbiyi
(74) *Attorney, Agent, or Firm* — Virginia G. Campen

(57) ABSTRACT

The invention provides a conjugate comprising an antigen and a carrier molecule, wherein the carrier molecule comprises a BP-2a antigen and a spb1 antigen. BP-2a and spb1 are *Streptococcus agalactiae* antigens. The conjugate may be used in a method for raising an immune response in a mammal, the method comprising administering the conjugate to the mammal. Also provided are pharmaceutical compositions, particularly vaccines, comprising the conjugate.

18 Claims, 14 Drawing Sheets
Specification includes a Sequence Listing.

```
↓ N terminus methionine            ↓ 515 D3 sub-fragment (SEQ ID NO:38)
MGNNPTIENEPKEGIPVDKKITVNKTWAVDGNEVNKADETVDAVFTLQVKDGDKWVNVDS  60
                                            Linker (SEQ ID NO:277) ↓
AKATAATSFKHTFENLDNAKTYRVIERVSGYAPEYVSFVNGVVTIKNNKDSNEPTPI GSG  120
        ↓ H36b D3 sub-fragment (SEQ ID NO:42)
S GNKPGKKVKEIPVTPSNGEITVSKTWDKGSDLENANVVYTLKDGGTAVASVSLTKTTPN  180

GEINLGNGIKFTVTGAFAGKFSGLTDSKTYMISERIAGYGNTITTGAGSAAITNTPDSDN  240
        ↓ Linker (SEQ ID NO:277)          ↓ CJB111 D3 sub-fragment (SEQ ID NO:40)
PTPL GSGS GNNPTEESEPQEGTPANQEIKVIKDWAVDGTITDANVAVKAIFTLQEKQTDG  300

TWVNVASHEATKPSRFEHTFTGLDNAKTYRVVERVSGYTPEYVSFKNGVVTIKNNKNSND  360
        ↓ Linker (SEQ ID NO:277)          ↓ 2603 D3 sub-fragment (SEQ ID NO:36)
PTPI GSGS GNKPGKDLTELPVTPSKGEVTVAKTWSDGIAPDGVNVVYTLKDKDKTVASVS  420

LTKTSKGTIDLGNGIKFEVSGNFSGKFTGLENKSYMISERVSGYGSAINLENGKVTITNT  480
            ↓ Linker (SEQ ID NO:277)
KDSDNPTPL GSGS GNKPGTDLSEQPVTPEDGEVKVTKTWAAGANKADAKVVYTLKNATKQ  540
                        ↓ CJB110 D3 sub-fragment (SEQ ID NO:44)
VVASVALTAADTKGTINLGKGMTFEITGAFSGTFKGLQNKAYTVSERVAGYTNAINVTGN  600
                        ↓ Linker (SEQ ID NO:277)
AVAITNTPDSDNPTPL GSGS GNNPTTENEPQTGNPVNKEITVRKTWAVDGNEVNKGDEKV  660
        ↓ DK21 D3 sub-fragment (SEQ ID NO:46)
DAVFTLQVKDSDKWVNVDSATATAATDFKYTFKNLDNAKTYRVVERVSGYAPAYVSFVGG  720
                    ↓ Linker (SEQ ID NO:272)
VVTIKNNKNSNDPTPI GSGGGG ETGTITVQDTQKGATYKAYKVFDAEIDNANVSDSNKDG  780
        ↓ spb1 lacking N-terminal and C-terminal sequences(SEQ ID NO:207)
ASYLIPQGKEAEYKASTDFNSLFTTTTPNGGRTYVTKKDTASANEIATWAKSISANTTPVS  840

TVTESNNDGTEVINVSQYGYYYVSSTVNNGAVIMVTSVTPNATIHEKNTDATWGDGGGKT  900

VDQKTYSVGDTVKYTITYKNAVNYHGTEKVYQYVIKDTMPSASVVDLNEGSYEVTITDGS  960

GNITTLTQGSEKATGKYNLLEENNNFTITIPWAATNTPTGNTQNGANDDFFYKGINTITV  1020

TYTGVLKSGAKPGSADLPENTNIATINPNTSNDDPGQKVTVRDGQITIKKIDGSTKASLQ  1080

GAIFVLKNATGQFLNFNDTNNVEWGTEANATEYTTGADGIITITGLKEGTYYLVEKKAPL  1140

GYNLLDNSQKVILGDGATDTTNSDNLLVNPTVENNKGTE  1179
```

*Fig. 12*

| Polysaccharide | Repeat Unit |
|---|---|
| Haemophilus influenzae Type b ("PRP") | →3)-β-D-Ribf-(1→1)-D-Ribitol-(5→OPO₃→ |
| Neisseria meningitidis | |
| Group A | →6)-α-D-ManpNAc(3OAc)-β-(1→OPO₃→ |
| Group C | →9)-α-D-Neu5Ac(7/8OAc)-(2→ |
| Group W135 | →6)-α-D-Galp-(1→4)-α-D-Neu5Ac(9OAc)-(2→ |
| Group Y | →6)-α-D-Glcp-(1→4)-α-D-Neu5Ac(9OAc)-(2→ |
| Salmonella enterica Typhi Vi | →α-D-GalpNAcA(3OAc)-(1→ |
| Streptococcus pneumoniae | |
| Type 1 | →3)-D-AAT-α-Galp-(1→4)-α-D-GalpA(2/3OAc)-(1→3)-α-D-GalpA→ |
| Type 2 | →4)-β-D-Glcp-(1→3)-[α-D-GlcpA-(1→6)-α-D-Glcp-(1→2)]-α-L-Rhap-(1→3)-α-L-Rhap-(1→3)-L-Rhap-(1→ |
| Type 3 | →3)-β-D-GlcA-(1→4)-3-D-Glcp-(1→ |
| Type 4 | →3-β-D-ManpNAc-(1→3)-α-L-FucpNAc-(1→3)-α-D-GalpNAc-(1→4)-α-D-Galp2,3(S)Py-(1→ |
| Type 5 | →4)-β-D-Glcp-(1→4)-[α-L-PnepNAc-(1→2)-β-D-GlcpA-(1→3)]-α-L-FucpNAc-(1→3)-β-D-Sugp-(1→ |
| Type 6B | →2)-α-D-Galp-(1→3)-α-D-Glcp-(1→3)-α-L-Rhap-(1→4)-D-Rib-ol-(5→P→ |
| Type 9N | →4)-α-D-GlcpA-(1→3)-α-D-GalpNAc-(1→3)-β-D-ManpNAc-(1→4)-β-D-Glcp-(1→4)-α-D-GlcpNAc-(1→ |
| Type 14 | →4)-β-D-Glcp-(1→6)-[β-D-Galp-(1→4)]-β-D-GlcpNAc-(1→3)-β-D-Galp-(1→ |
| Type 18C | →4)-β-D-Glcp-(1→4)-[α-D-Glcp(6OAc)-(1→2)][(Gro-(1→P→3)]-β-D-Galp-(1→4)-α-D-Glcp-(1→4)-3)-α-L-Rhap-(1→ |
| Type 19A | →4)-β-D-ManpNAc-(1→4)-α-D-Glcp-(1→3)-α-L-Rhap-(1→P→ |
| Type 19F | →4)-β-D-ManpNAc-β-(1→4)-α-D-Glcp-(1→2)-α-L-Rhap-(1→P→ |
| Type 23F | →4)-β-D-Glcp-(1→4)-[α-L-Rhap-(1→2)[Gro-(2→P→3)]-β-D-Galp-(1→4)-β-L-Rhap-(1→ |
| Staphylococcus aureus | |
| Type 5 | →4)-β-D-ManNAcA(3OAc)-(1→4)-α-L-FucNAc-(1→3)-β-D-FucNAc-(1→ |
| Type 8 | →4)-β-D-ManNAcA(4OAc)-(1→3)-α-L-FucNAc-(1→3)-β-D-FucNAc-(1→ |

AAT is 2-acetamido-4-amino-2,4,6-trideoxygalactose, Gro is glycerol, Pne is 2-acetamido-2,6,6-dideoxytalose and P is phosphate in a phosphodiester linkage.

Fig. 13

CARRIER MOLECULE FOR ANTIGENS

This application is filed pursuant to 35 U.S.C. § 371 as a United States National Phase Application of International Patent Application Serial No. PCT/EP2015/068012 filed Aug. 5, 2015, which claims priority to European Application No. EP14179945.2 filed Aug. 5, 2014, and the entire contents of each of the foregoing applications are hereby incorporated by reference.

TECHNICAL FIELD

The invention relates to conjugates of antigens and carrier molecules, and vaccines comprising these conjugates. The antigens are typically saccharides.

BACKGROUND

The use of conjugation to carrier proteins in order to enhance the immunogenicity of saccharide antigens is well known [e.g., reviewed in refs. 1 to 9 etc.] and is used in particular for paediatric vaccines [10]. Three widely used carrier proteins in present-day vaccines are tetanus toxoid (TT), diphtheria toxoid (DT) and the diphtheria toxoid variant, $CRM_{197}$. These proteins have been used as carriers for various saccharides, including streptococcal and meningococcal capsular saccharides (see, for example, the use of TT as carrier for saccharides derived from *Streptococcus agalactiae* serotypes II and III in ref. 11 and for saccharides derived from *Neisseria meningitidis* serogroups A, C, W135 and Y in ref. 12; and the use of DT and $CRM_{197}$ as carriers for the same *N. meningitidis* saccharides in refs. 13 and 14 and for saccharides derived from *Streptococcus agalactiae* serotypes Ia, Ib and III in ref. 15). Concerns have been raised about the overuse of these carrier proteins in vaccines [see, for example, ref. 16], with various alternative carriers being suggested (e.g. protein D from *Haemophilus influenzae* in ref. 17). However, many alternative carrier proteins are not as effective as TT, DT and/or CRM197. Accordingly, there remains a need to find alternative and/or better carrier proteins.

It is therefore an object of the invention to provide further and better carrier proteins, particularly carrier proteins for capsular saccharides. The carrier proteins may be used in conjugates to induce protective and/or therapeutic immune responses against infections or drugs.

SUMMARY OF THE INVENTION

The inventors have found that carriers comprising two specific *Streptococcus agalactiae* (GBS) polypeptides, a BP-2a polypeptide and a spb1 polypeptide, are particularly effective. These carriers are versatile and may be conjugated to various antigens, particularly saccharides e.g., from pathogenic organisms. The resultant conjugates may be more immunogenic than conjugates based on currently used carrier proteins, e.g., $CRM_{197}$. Moreover, they may provide higher levels of protective immunity against GBS when used as carriers of GBS saccharides.

The invention therefore provides a conjugate comprising an antigen and a carrier molecule, wherein the carrier molecule comprises a BP-2a polypeptide and a spb1 polypeptide. The carrier molecule typically comprises the BP-2a polypeptide and a spb1 polypeptide as a single polypeptide chain (a "hybrid" polypeptide). Typically, the antigen is a saccharide. The saccharide may be any saccharide, particularly a saccharide from a pathogenic organism. For example, the saccharide may be a capsular saccharide from *Streptococcus agalactiae*, *Neisseria meningitidis*, or *Streptococcus pneumoniae*, or a glucan. When the saccharide is a capsular saccharide from *Streptococcus agalactiae*, it is typically from one of the following serotypes: Ia, Ib, II, III and V, and in particular from serotypes II or V. The use of polypeptide carriers of the invention as carriers for saccharides from different strains of *Streptococcus agalactiae*, may be advantageous in providing improved immune responses or in providing protection against multiple strains, thereby extending vaccine coverage.

When the saccharide is a capsular saccharide from *N. meningitidis*, it is typically from one of the following meningococcal serogroups: A, C, W135 and Y. When the saccharide is a glucan, it is typically a laminarin. When the saccharide is a capsular saccharide from *S. pneumoniae*, it is typically from one of the following pneumococcal serotypes: 1, 2, 3, 4, 5, 6A, 6B, 7F, 8, 9N, 9V, 10A, 11A, 12F, 14, 15B, 17F, 18C, 19A, 19F, 20, 22F, 23F and 33F.

The use of polypeptide carriers of the invention as carriers for heterologous saccharides, i.e. for saccharides not found naturally in, for example *Streptococcus agalactiae*, may be advantageous in providing protection against two or more different microorganisms thereby extending vaccine coverage.

The present invention also relates to pharmaceutical compositions comprising a conjugate of the invention in combination with a pharmaceutically acceptable carrier. Particularly, the present invention relates to pharmaceutical compositions comprising (i) a conjugate according to the invention, (ii) saccharides from *Streptococcus agalactiae* serotype Ia, Ib and III conjugated to CRM197 and (iii) a saccharide from *Streptococcus agalactiae* serotype II or V conjugated to GBS80. Yet more particularly, the present invention relates to pharmaceutical compositions comprising (i) a saccharide from *Streptococcus agalactiae* serotype V conjugated to a GBS59(6XD3)-GBS1523 carrier, (ii) saccharides from *Streptococcus agalactiae* serotype Ia, Ib and III conjugated to CRM197 and (iiI) a saccharide from *Streptococcus agalactiae* serotype II conjugated to GBS80. Still yet more particularly, the present invention relates to pharmaceutical compositions comprising (i) a saccharide from *Streptococcus agalactiae* serotype II conjugated to a GBS59(6XD3)-GBS1523 carrier, (ii) saccharides from *Streptococcus agalactiae* serotype Ia, Ib and III conjugated to CRM197 and (iiI) a saccharide from *Streptococcus agalactiae* serotype V conjugated to GBS80.

The present invention further relates to methods for raising an immune response in a suitable mammal, comprising administering a conjugate or pharmaceutical composition of the invention to the mammal.

BRIEF DESCRIPTION OF DRAWINGS

FIG. 12 provides the sequence of carrier protein GBS59 (6XD3)-GBS1523 (SEQ ID NO:276) and highlights its constituent portions. Linker sequences are boxed, whilst different BP-2a and spb1 sequences are marked with alternating single and double underlining.

FIG. 13 provides the repeating units of representative bacterial saccharides for use in the conjugates of the invention.

DETAILED DESCRIPTION OF THE INVENTION

Figure 1:
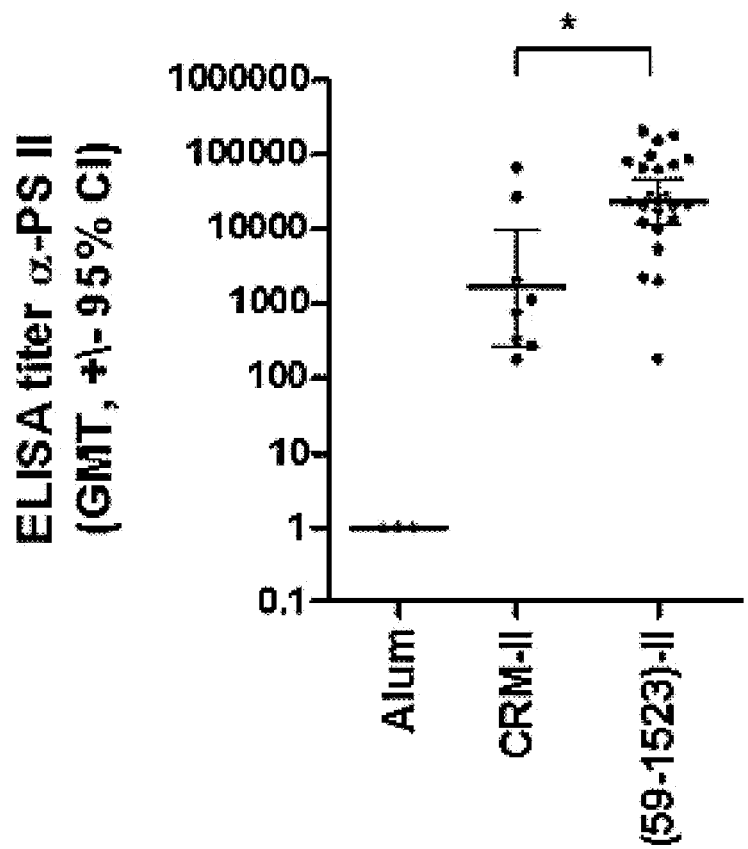
FIG. 1 compares the protection (lower row of the table) and the anti-serotype-II saccharide antibody titres (graph and upper rows of the table) elicited by immunisation with conjugates comprising serotype-II saccharide, $CRM_{197}$ and BP-2a/spb1 carriers, in two studies. Compositions were administered at a dose of 1 μg protein.

The invention involves a conjugate comprising an antigen and a carrier molecule, wherein the carrier molecule comprises a BP-2a polypeptide and a spb1 polypeptide. The features of this conjugate are described in detail below.

With regard to Group B *Streptococcus*, a vaccine based solely on capsular polysaccharide(s) will not be effective in eliciting optimal protection from non-typeable (NT) GBS infection because NT isolates produce very low levels of capsule or have modified capsular structures that do not react with antiserum obtained from any of the nine known serotypes. The use of GBS protein antigens, particularly as carriers of polysaccharide, is advantageous because unlike non-GBS carriers, such as CRM197, GBS protein antigens elicit a protective immunologic response against GBS. Thus, the use of GBS carrier molecules of the invention as protein carriers for GBS polysaccharide(s) in a vaccine composition increases vaccine coverage. Non-prevalent serotypes of colonizing GBS (e.g., types IV and VII) may emerge in a population vaccinated with a multivalent vaccine against currently predominant colonizing serotypes in a process called "serotype replacement". For GBS vaccines, the use of conjugates of the invention may also tackle such concerns around serotype replacement.

The Carrier Molecule

The carrier molecule comprises a BP-2a polypeptide and a spb1 polypeptide. Preferably, the carrier molecule comprises the BP-2a polypeptide and the spb1 polypeptide as a single polypeptide chain (a "hybrid" polypeptide).

BP-2a

*Streptococcus agalactiae* (Group B *Streptococcus*, GBS) has three pilus variants, each encoded by a distinct pathogenicity island, PI-1, PI-2a and PI-2b [18,19]. Each pathogenicity island consists of 5 genes coding for: the pilus backbone protein (BP); 2 ancillary proteins (AP1 and AP2); and 2 sortase proteins that are involved in the assembly of the pili. All GBS strains carry at least one of these 3 pathogenicity islands and the sequences of the pilus structural proteins (BP, AP1 and AP2) encoded by these pathogenicity islands are generally well conserved. However, the sequence of the backbone protein encoded by pathogenicity island 2a, varies between GBS strains. The BP-2a pilus subunit has at least seven clades and the sequence identity between these clades is as low as 48%. The BP-2a polypeptide may also be referred to as GBS59 or SAL1486.

Reference amino acid sequences for the seven BP-2a clades are SEQ ID NO:1 (derived from GBS strain 2603), SEQ ID NO:2 (derived from GBS strain 515), SEQ ID NO:3 (derived from GBS strain CJB111), SEQ ID NO:4 (derived from GBS strain H36B), SEQ ID NO:5 (derived from GBS strain CJB110), SEQ ID NO:6 (derived from GBS strain DK21) and SEQ ID NO:7 (derived from GBS strain NEM316) herein. The inventors have determined that BP-2a polypeptides are useful as carrier molecules when combined with a spb1 polypeptide.

Preferred BP-2a polypeptides for use with the invention comprise: an amino acid sequence selected from the group consisting of SEQ ID NOs:1-7; a fragment of at least 20 contiguous amino acids (e.g. at least 25, 30, 35, 40, 50, 60, 70, 80, 90, 100, 150, 200, 250) of an amino acid sequence selected from the group consisting of SEQ ID NOs:1-7; or an amino acid sequence having at least 70% identity (e.g., at least 75%, 80%, 85%, 90%, 91%, 92%, 93%, 94%, 95%, 96%, 97%, 98%, 99%, 99.5%) to an amino acid sequence selected from the group consisting of SEQ ID NOs:1-7 or having said identity to said fragment of an amino acid sequence selected from the group consisting of SEQ ID NOs:1-7; or a fragment of between 20 and 250 contiguous amino acids, 25 and 250 contiguous amino acids, 30 and 250 contiguous amino acids, 40 and 250 contiguous amino acids, 50 and 170 contiguous amino acids, 50 and 165 contiguous amino acids of an amino acid sequence selected from the group consisting of SEQ ID NOs:1-7. The BP-2a polypeptide of the invention preferably comprises at least one CD4+ T cell epitope. Preferred fragments lack one or more amino acids (e.g., 1, 2, 3, 4, 5, 6, 7, 8, 9, 10, 15, 20, 25, 30, 35, 40, 45 or more) from the C-terminus and/or one or more amino acids (e.g., 1, 2, 3, 4, 5, 6, 7, 8, 9, 10, 15, 20, 25, 30, 35, 40, 45 or more) from the N-terminus of an amino acid sequence selected from the group consisting of SEQ ID NOs:1-7 while retaining at least one epitope of an amino acid sequence selected from the group consisting of SEQ ID NOs:1-7. Other fragments omit one or more protein domains.

The BP-2a polypeptide of the invention comprises at least one CD4+ T cell epitope. CD4+ T cells help B lymphocytes to produce antibodies against antigens [20]. T-cell epitopes can be identified empirically (e.g. using PEPSCAN [21,22] or similar methods), or they can be predicted (e.g. using the Jameson-Wolf antigenic index [23], matrix-based approaches [24], TEPITOPE [25], neural networks [26], OptiMer & EpiMer [27,28], ADEPT [29], Tsites [30], hydrophilicity [31], antigenic index [32] or the methods disclosed in reference 33, etc.).

Preferred BP-2a polypeptides for use with the invention comprise or consist of immunogenic domains that may comprise important CD4+ T cell epitopes. Exemplary domains present in the different BP-2a clades are provided below.

The BP-2a protein can be split into four domains (D1 to D4) between the end of its leader peptide and the start of its LPXTG anchor. These four domains are as follows in SEQ ID NOs: 1 to 7, and the positions in further BP-2a sequences which correspond to these residues can readily be identified by alignment:

TABLE 1

|   | D1 | D2 | D3 | D4 |
|---|---|---|---|---|
| SEQ ID NO: 1 (2603) | 30-175 | 169-369 (SEQ ID NO: 8) | 363-509 (SEQ ID NO: 9) | 503-670 (SEQ ID NO: 10) (SEQ ID NO: 11) |
| SEQ ID NO: 2 (515) | 30-162 (SEQ ID NO: 12) | 156-338 (SEQ ID NO: 13) | 332-499 (SEQ ID NO: 14) | 472-640 (SEQ ID NO: 15) |
| SEQ ID NO: 3 (cjb111) | 30-162 (SEQ ID NO: 16) | 155-337 (SEQ ID NO: 17) | 331-474 (SEQ ID NO: 18) | 468-639 (SEQ ID NO: 19) |
| SEQ ID NO: 4 (h36b) | 30-158 (SEQ ID NO: 20) | 152-350 (SEQ ID NO: 21) | 343-493 (SEQ ID NO: 22) | 487-658 (SEQ ID NO: 23) |
| SEQ ID NO: 5 (CJB110) | 30-172 (SEQ ID NO: 24) | 166-365 (SEQ ID NO: 25) | 359-507 (SEQ ID NO: 26) | 501-669 (SEQ ID NO: 27) |
| SEQ ID NO: 6 (DK21) | 30-168 (SEQ ID NO: 28) | 162-344 (SEQ ID NO: 29) | 338-480 (SEQ ID NO: 30) | 475-647 (SEQ ID NO: 31) |
| SEQ ID NO: 7 (NEM316) | 30-162 (SEQ ID NO: 32) | 155-337 (SEQ ID NO: 33) | 331-474 (SEQ ID NO: 34) | 468-639 (SEQ ID NO: 35) |

The sub-fragments of domain D3 identified below (SEQ ID NOs: 36, 38, 40, 42, 44, 46 and 48) are surface-exposed fragments. The inventors have identified that these D3 sub-fragments may be particularly effective carriers when combined with spb1 polypeptides.

TABLE 2

|   | D3 sub-fragments | D4 sub-fragments (helices) |
|---|---|---|
| SEQ ID NO: 1 (2603) | 363-483 (SEQ ID NO: 36) | 484-588 (SEQ ID NO: 37) |
| SEQ ID NO: 2 (515) | 332-447 (SEQ ID NO: 38) 411-436 (SEQ ID NO: 270) | 448-554 (SEQ ID NO: 39) |
| SEQ ID NO: 3 (cjb111) | 331-446 (SEQ ID NO: 40) | 447-553 (SEQ ID NO: 41) |
| SEQ ID NO: 4 (h36b) | 343-465 (SEQ ID NO: 42) | 466-572 (SEQ ID NO: 43) |
| SEQ ID NO: 5 (CJB110) | 359-481 (SEQ ID NO: 44) | 482-588 (SEQ ID NO: 45) |
| SEQ ID NO: 6 (DK21) | 338-453 (SEQ ID NO: 46) | 454-561 (SEQ ID NO: 47) |
| SEQ ID NO: 7 (NEM316) | 331-446 (SEQ ID NO: 48) | 447-553 (SEQ ID NO: 49) |

Smaller epitopes within these surface-exposed fragments can be readily identified by the skilled person and used in the compositions of the invention. For example, two monoclonal antibodies (17C4/A3 and 4H11/B7, SEQ ID NOs: 262-269) have been found to bind an epitope comprising amino acids 411-436 (SEQ ID NO: 270) within the D3 sub-fragment from the 515 Glade (SEQ ID NO: 38, fragment of SEQ ID NO: 2). The sub-fragments of domain D4 identified below comprise the two helices (referred to herein as D4H) present at the N-terminal of domain D4 and not the remainder of the D4 domain. These helices are predicted to be surface-exposed.

Therefore, in certain embodiments, BP-2a polypeptides for use with the invention comprise an amino acid sequence selected from the above domains, a fragment of at least 20 amino acids of one of the above domains, or an amino acid sequence having at least 70% identity to said domains or fragments.

In preferred embodiments, the BP-2a polypeptides for use with the invention comprise a D3 fragment, of homologue thereof. D3 fragments have been shown to induce a protective immune response [34]. In particularly preferred embodiments the BP-2a polypeptides for use with the invention comprise or consist of a D3 sub-fragment. Such polypeptides may be particularly effective carriers when used in combination with an spb1 polypeptide. Therefore, BP-2a polypeptides for use with the invention may consist of fragments of SEQ ID NOS: 1, 2, 3, 4, 5, 6 or 7 comprising or consisting of domain D3 or a D3 sub-fragment, as identified above. Particularly preferred BP-2a polypeptides for use with the invention comprise: an amino acid sequence selected from the group consisting of SEQ ID NOs: 36, 38, 40, 42, 44, 46 and 48; a fragment of at least 20 contiguous amino acids (e.g., at least 25, 30, 35, 40, 50, 60, 70, 80, 90, 100, 150, 200, 250) of an amino acid sequence selected from the group consisting of SEQ ID NOs: 36, 38, 40, 42, 44, 46 and 48; or an amino acid sequence having at least 70% identity (e.g., at least 75%, 80%, 85%, 90%, 91%, 92%, 93%, 94%, 95%, 96%, 97%, 98%, 99%, 99.5%) to an amino acid sequence selected from the group consisting of SEQ ID NOs: 36, 38, 40, 42, 44, 46 and 48 or having said identity to said fragment of an amino acid sequence selected from the group consisting of SEQ ID NOs: 36, 38, 40, 42, 44, 46 and 48. Other BP-2a polypeptides for use with the invention comprise: a fragment comprising or consisting of no more than 20 contiguous amino acids (for example, no more than 25, 30, 35, 40, 50, 60, 70, 80, 90, 100, 150, 200, 250 contiguous amino acids) of an amino acid sequence selected from the group consisting of SEQ ID NOs: 36, 38, 40, 42, 44, 46 and 48. Fragments of the D3 sub-fragments are envisaged, for example, fragments lacking one or more amino acids (e.g., 1, 2, 3, 4, 5, 6, 7, 8, 9, 10, 15, 20, 25, 30, 35, 40, 45 or more) from the C-terminus and/or one or more amino acids (e.g., 1, 2, 3, 4, 5, 6, 7, 8, 9, 10, 15, 20, 25, 30, 35, 40, 45 or more) from the N-terminus of an amino acid sequence selected from the group consisting of SEQ ID NOs: 36, 38, 40, 42, 44, 46 and 48 while retaining at least one epitope of an amino acid sequence selected from the group consisting of SEQ ID NOs: 36, 38, 40, 42, 44, 46 and 48. In some cases, even smaller fragments may be used. For example, a polypeptide may consist of a fragment of SEQ ID NO:3 comprising SEQ ID NO:78 (amino acids 411 to 436 of SEQ ID NO:3).

Although D3 fragments and D3 sub-fragments are preferred BP-2a polypeptides for use with the invention, fragments may retain domains D4, D2 and/or D1 in addition to epitopes from domain D3. Polypeptides of the invention may therefore consist of fragments of SEQ ID NOS: 1, 2, 3, 4, 5, 6 or 7 comprising or consisting of i) domains D2 and D3; ii) domains D3 and D4; iii) domains D1, D2 and D3; or iv) domains D2, D3 and D4, as identified above. Exemplary fragments are provided below. These fragments containing combinations of domains D2, D3, and D4 (or D4H) as set out below:

TABLE 3

| | D3 + D4 | D3 + D4H | D2 + D3 + D4 | D2 + D3 + D4H |
|---|---|---|---|---|
| SEQ ID NO: 1 (2603) | SEQ ID NO: 50 | SEQ ID NO: 51 | SEQ ID NO: 52 | SEQ ID NO: 53 |
| SEQ ID NO: 2 (515) | SEQ ID NO: 54 | SEQ ID NO: 55 | SEQ ID NO: 56 | SEQ ID NO: 57 |
| SEQ ID NO: 3 (cjb111) | SEQ ID NO: 58 | SEQ ID NO: 59 | SEQ ID NO: 60 | SEQ ID NO: 61 |
| SEQ ID NO: 4 (h36b) | SEQ ID NO: 62 | SEQ ID NO: 63 | SEQ ID NO: 64 | SEQ ID NO: 65 |
| SEQ ID NO: 5 (CJB110) | SEQ ID NO: 66 | SEQ ID NO: 67 | SEQ ID NO: 68 | SEQ ID NO: 69 |
| SEQ ID NO: 6 (DK21) | SEQ ID NO: 70 | SEQ ID NO: 71 | SEQ ID NO: 72 | SEQ ID NO: 73 |
| SEQ ID NO: 7 (NEM316) | SEQ ID NO: 74 | SEQ ID NO: 75 | SEQ ID NO: 76 | SEQ ID NO: 77 |

Amino acid sequences used with the invention, may, compared to SEQ ID NOs: 1, 2, 3, 4, 5, 6, or 7 or fragments thereof include one or more (e.g. 1, 2, 3, 4, 5, 6, 7, 8, 9, 10, etc.) conservative amino acid replacements i.e. replacements of one amino acid with another which has a related side chain. Genetically-encoded amino acids are generally divided into four families: (1) acidic i.e. aspartate, glutamate; (2) basic i.e. lysine, arginine, histidine; (3) non-polar i.e. alanine, valine, leucine, isoleucine, proline, phenylalanine, methionine, tryptophan; and (4) uncharged polar i.e. glycine, asparagine, glutamine, cysteine, serine, threonine, tyrosine. Phenylalanine, tryptophan, and tyrosine are sometimes classified jointly as aromatic amino acids. In general, substitution of single amino acids within these families does not have a major effect on the biological activity. The polypeptides may have one or more (e.g. 1, 2, 3, 4, 5, 6, 7, 8, 9, 10, etc.) single amino acid deletions relative to a reference sequence. The polypeptides may also include one or more (e.g. 1, 2, 3, 4, 5, 6, 7, 8, 9, 10, etc.) insertions (e.g. each of 1, 2, 3, 4 or 5 amino acids) relative to a reference sequence.

In preferred embodiments, the carrier comprises more than one BP-2a polypeptide. The inventors have shown that carriers comprising multiple BP-2a polypeptides may be particularly effective carriers when used in combination with an spb1 polypeptide. Therefore, in preferred embodiments, the carrier comprises at least 2, at least 3, at least 4, at least 5, at least 6 or at least 7 BP-2a polypeptides. When more than one BP-2a polypeptide is present, each BP-2a polypeptide is generally from a different strain.

Conjugates of the invention may comprise: at least two (e.g. at least 3, at least 4, at least 5, at least 6 or at least 7) amino acid sequences selected from the group consisting of SEQ ID NOs:1-7; at least two fragments of at least 20 contiguous amino acids (e.g. 25, 30, 35, 40, 50, 60, 70, 80, 90, 100, 150, 200, 250 or more) or no more than 20 contiguous amino acids (e.g. 25, 30, 35, 40, 50, 60, 70, 80, 90, 100, 150, 200, 250 or fewer) of amino acid sequences selected from the group consisting of SEQ ID NOs:1-7; or at least two amino acid sequences having at least 70% identity (e.g. at least 75%, 80%, 85%, 90%, 91%, 92%, 93%, 94%, 95%, 96%, 97%, 98%, 99%, 99.5%) to amino acid sequences selected from the group consisting of SEQ ID NOs:1-7 or having said identity to said fragments of amino acid sequences selected from the group consisting of SEQ ID NOs:1-7.

The carrier may comprise corresponding BP-2a domains from different strains. For example, the carrier may comprise D3 domains or D3 sub-fragments from 2, 3, 4, 5, 6 or 7 different strains.

Generally, each BP-2a polypeptide will be present in a single polypeptide chain. When multiple BP-2a polypeptides are present in a single polypeptide chain, they may be separated by linkers. Suitable linkers include short peptide sequences which facilitate cloning, poly-glycine linkers (i.e. comprising $Gly_n$ where n=2, 3, 4, 5, 6, 7, 8, 9, 10 or more (SEQ ID NO: 295)), and histidine tags (i.e. $His_n$ where n=3, 4, 5, 6, 7, 8, 9, 10 or more (SEQ ID NO: 296)). Other suitable linker amino acid sequences will be apparent to those skilled in the art. By way of non-limiting example, useful linkers may include GSGS (SEQ ID NO:277), GSGGGG (SEQ ID NO:272) or GSGSGGGG (SEQ ID NO:273). The polypeptide chain comprising BP-2a polypeptides (and optionally linkers) can be expressed as a fusion polypeptide using standard recombination expression techniques. As used herein, the term "single polypeptide chain" generally refers to a polypeptide chain in which all amino acids are linked sequentially by peptide bonds. A "single polypeptide chain" is usually generated by expression of a single DNA sequence. However, alternatively or in addition, two or more BP-2a polypeptides may be linked using standard chemical conjugation techniques, e.g., using straight or branched-chain carbon linkers, heterocyclic carbon linkers, carbohydrate linkers. For example, a linker can be attached through lysine or cysteine side chains. Thus, in some embodiments, recombinant fusion protein expression and chemical conjugation techniques may be used in combination to produce a single polypeptide chain comprising multiple BP-2a polypeptides.

The different BP-2a polypeptides may be present in any order in the polypeptide chain. Exemplary combinations are provided below. Each number in the table indicates the relevant SEQ ID NO.

TABLE 4

| SEQ ID | BP-2a peptide | Linker | BP-2a peptide | Linker | BP-2a peptide | Linker | BP-2a peptide | Linker | BP-2a peptide | Linker | BP-2a peptide |
|---|---|---|---|---|---|---|---|---|---|---|---|
| 83 (Fusion E) | 38 D3 frag 515 | 277 | 42 D3 frag h36b | 277 | 40 D3 frag cjb111 | 277 | 36 D3 frag 2603 | 277 | 44 D3 fragCJB110 | 277 | 46 D3 fragDK21 |
| 84 (Fusion F) | 55 D3 + D4H 515 | 277 | 59 D3 + D4H cjb111 | 277 | 67 D3 + D4H CJB110 | 277 | 51 D3 + D4H 2603 | 277 | 63 D3 + D4H h36b | 277 | 71 D3 + D4H DK21 |
| 85 (Fusion G) | 51 D3 + D4H 2603 | 277 | 55 D3 + D4H 515 | 277 | 63 D3 + D4H h36b | 277 | 59 D3 + D4H cjb111 | — | — | — | — |
| 86 (Fusion H) | 59 D3 + D4H cjb111 | 277 | 63 D3 + D4H h36b | 277 | 51 D3 + D4H 2603 | 277 | 55 D3 + D4H 515 | — | — | — | — |
| 87 (Fusion I) | 57 D2 + D3 + D4H 515 | 277 | 53 D2 + D3 + D4H 2603 | 277 | 61 D2 + D3 + D4H cjb111 | 277 | — | — | — | — | — |

Thus, examples of BP-2a polypeptide hybrids suitable for use in the invention include polypeptides comprising an amino acid sequence selected from the group consisting of: SEQ ID NO: 83; SEQ ID NO: 84; SEQ ID NO: 85; SEQ ID NO: 86; or SEQ ID NO: 87, and homologues having at least 70% identity to said sequences (e.g. at least 75%, 80%, 85%, 90%, 91%, 92%, 93%, 94%, 95%, 96%, 97%, 98%, 99%, 99.5%). Other suitable BP-2a hybrids are disclosed in International patent application publication WO2011/121576.

spb1

The original spb1(SAN1518; GBS1523) sequence was annotated in reference 35 as a cell wall surface anchor family protein (see GI: 77408651 or Uniprot accession No. Q8E479). The terms 'spb1' and 'GBS1523' are used interchangeably herein. For reference purposes, the amino acid sequence of full length spb1 as found in the COH1 strain is given as SEQ ID NO: 206 herein. Preferred spb1 polypeptides for use with the invention comprise: the amino acid sequence of SEQ ID NO:206; a fragment of at least 20 contiguous amino acids (e.g. 25, 30, 35, 40, 50, 60, 70, 80, 90, 100, 150, 200, 250 or more) of the amino acid sequence of SEQ ID NO:206; a fragment of less than 400 contiguous amino acids (e.g. 395, 390, 389, 388, 387, 386, 385, 384, 383 or less) of the amino acid sequence of SEQ ID NO:206; or an amino acid sequence having at least 70% identity (e.g. at least 75%, 80%, 85%, 90%, 91%, 92%, 93%, 94%, 95%, 96%, 97%, 98%, 99%, 99.5%) to the amino acid sequence of SEQ ID NO:206 or having said identity to said fragment of the amino acid sequence of SEQ ID NO:206. Particular spb1 fragments of the invention include fragment spb1$_{D2+D3}$ (referred to in the Examples as BP-2b$_{D2+D3}$ or BP-2b$_{185-468}$), a fragment consisting of amino acids 185 to 468 of full length spb1, particularly amino acids 185 to 468 of SEQ ID NO: 206 provided as SEQ ID NO:285. The inventors have shown that spb1 polypeptides may be particularly effective carriers when used in combination with a BP-2a polypeptide. These spb1 proteins include variants of SEQ ID NO: 206. The spb1 polypeptide of the invention preferably comprises at least one CD4+ T cell epitope. Preferred fragments lack one or more amino acids (e.g. 1, 2, 3, 4, 5, 6, 7, 8, 9, 10, 15, 20, 25, 30, 35, 40, 45 or more) from the C-terminus and/or one or more amino acids (e.g. 1, 2, 3, 4, 5, 6, 7, 8, 9, 10, 15, 20, 25, 30, 35, 40, 45 or more) from the N-terminus of SEQ ID NO: 206 while retaining at least one epitope of SEQ ID NO: 206. Other fragments omit one or more protein domains.

Wild-type spb1 contains a N-terminal leader or signal sequence region at amino acids 1 to 30 of SEQ ID NO:206 which may be removed in fragments, e.g. SEQ ID NO:207. Alternatively, or in addition, amino acids 468-502 of SEQ ID NO:206 may be removed in fragments, e.g. SEQ ID NO:207. Alternatively, or in addition, amino acids 1-185 of SEQ ID NO:206 may be removed in fragments. Therefore, in preferred embodiments, spb1 polypeptides for use with the invention comprise: the amino acid sequence of SEQ ID NO:207; a fragment of at least 20 contiguous amino acids (e.g. 25, 30, 35, 40, 50, 60, 70, 80, 90, 100, 150, 200, 250 or more) of the amino acid sequence of SEQ ID NO:207; a fragment of no more than 20 contiguous amino acids (e.g. 25, 30, 35, 40, 50, 60, 70, 80, 90, 100, 150, 200, 250, 260, 270, 280, 290 or fewer, for example 283 contiguous amino acids) of the amino acid sequence of SEQ ID NO:207; or an amino acid sequence having at least 70% identity (e.g. at least 75%, 80%, 85%, 90%, 91%, 92%, 93%, 94%, 95%, 96%, 97%, 98%, 99%, 99.5%) to the amino acid sequence of SEQ ID NO:206 or having said identity to said fragment of the amino acid sequence of SEQ ID NO:207. In particularly preferred embodiments, the spb1 polypeptide comprises or consists of the amino acid sequence of SEQ ID NO:207.

The wild-type spb1 sequence contains an amino acid motif indicative of a cell wall anchor (LPSTG) at amino acids 468-472 of SEQ ID NO:206. In some recombinant host cell systems, it may be preferable to remove this motif to facilitate secretion of a recombinant polypeptide from the cell. Alternatively, it may be preferable to use the cell wall anchor motif to anchor the recombinantly expressed polypeptide to the cell wall. The extracellular domain of the expressed polypeptide may be cleaved during purification or the recombinant polypeptide may be left attached to either inactivated host cells or cell membranes in the final composition. An E box containing a conserved glutamic residue has also been identified at amino acids 419-429 of SEQ ID NO:206, with a conserved glutamic acid at residue 423. The E box motif may be important for the formation of oligomeric pilus-like structures, and so useful fragments of spb1 may include the conserved glutamic acid residue. A mutant of spb1 has been identified in which the glutamine (Q) at position 41 of SEQ ID NO:206 is substituted for a lysine (K), as a result of a mutation of a codon in the encoding nucleotide sequence from CAA to AAA. This substitution may be present in the spb1 sequences and spb1 fragments (e.g. SEQ ID NO:208).

Hybrid Polypeptides

Typically, the spb1 polypeptide and the BP-2a polypeptide or BP-2a polypeptides are expressed as a single polypeptide chain (a 'hybrid' polypeptide). Hybrid polypeptides can be represented by the formula NH$_2$-A-$\{$-X-L-$\}_n$-B—COOH, wherein: A is an optional N-terminal amino acid sequence; B is an optional C-terminal amino acid sequence; n is an integer of 2 or more (e.g. 2, 3, 4, 5, 6, etc.); each X is an amino acid sequence of a spb1 polypeptide or a BP-2a polypeptide (as described above), wherein at least one X is a spb1 polypeptide and at least one X is a BP-2a polypeptide; and L is an optional linker amino acid sequence. When n is 2, $X_1$ is usually a BP-2a polypeptide and $X_2$ is usually a spb1 polypeptide. When n is more than 2, each spb1 polypeptide (when more than one is present) may be the same or different and each BP-2a polypeptide (when more than one is present) may be the same or different.

The spb1 polypeptide or BP-2a polypeptide that is the amino acid sequence of each X is as defined above. Where these polypeptides are defined in terms of comprising an amino acid sequence having at least a certain percentage identity to a given spb1 or BP-2a polypeptide or fragment, the level of identity may be the same for each X.

For each n instances of $\{$—X-L-$\}$, linker amino acid sequence -L- may be present or absent. For instance, when n=2 the hybrid may be NH$_2$—X$_1$-L$_1$-X$_2$-L$_2$-COOH, NH$_2$—X$_1$—X$_2$—COOH, NH$_2$—X$_1$-L$_1$-X$_2$—COOH, NH$_2$—X$_1$—X$_2$-L$_2$-COOH, etc. Linker amino acid sequence(s) -L- will typically be short (e.g. 20 or fewer amino acids i.e. 20, 19, 18, 17, 16, 15, 14, 13, 12, 11, 10, 9, 8, 7, 6, 5, 4, 3, 2, 1). Examples comprise short peptide sequences which facilitate cloning, poly-glycine linkers (i.e. comprising Gly$_n$ where n=2, 3, 4, 5, 6, 7, 8, 9, 10 or more (SEQ ID NO: 295)), and histidine tags (i.e. His$_n$ where n=3, 4, 5, 6, 7, 8, 9, 10 or more (SEQ ID NO: 296)). Other suitable linker amino acid sequences will be apparent to those skilled in the art. A useful linker is GSGS (SEQ ID NO:277), GSGGGG (SEQ ID NO:272) or GSGSGGGG (SEQ ID NO:273), with the Gly-Ser dipeptide being formed from a BamHI restriction site, thus aiding cloning and manipulation, and the (Gly)$_4$ tetrapeptide (SEQ ID NO: 297) being a typical poly-glycine linker. Other suitable linkers, particularly for use as the final L$_n$ are a Leu-Glu dipeptide or SEQ ID NO:274. SEQ ID NO:277 is preferred for linking different BP-2a polypeptides. SEQ ID NO:272 is preferred for linking BP-2a polypeptides and spb1 polypeptides.

-A- is an optional N-terminal amino acid sequence. This will typically be short (e.g. 40 or fewer amino acids i.e. 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct protein trafficking, or short peptide sequences which facilitate cloning or purification (e.g. histidine tags i.e. $His_n$ where n=3, 4, 5, 6, 7, 8, 9, 10 or more (SEQ ID NO: 296)). Other suitable N-terminal amino acid sequences will be apparent to those skilled in the art. If $X_1$ lacks its own N-terminus methionine, -A- is preferably an oligopeptide (e.g. with 1, 2, 3, 4, 5, 6, 7 or 8 amino acids) which provides a N-terminus methionine e.g. Met-Ala-Ser, or a single Met residue. A preferred -A- is a single Met residue.

-B- is an optional C-terminal amino acid sequence. This will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include sequences to direct protein trafficking, short peptide sequences which facilitate cloning or purification (e.g. comprising histidine tags i.e. $His_n$ where n=3, 4, 5, 6, 7, 8, 9, 10 or more (SEQ ID NO:296), such as SEQ ID NO:275), or sequences which enhance protein stability. Other suitable C-terminal amino acid sequences will be apparent to those skilled in the art. Preferably, —B— is absent.

It is preferred that -A-, -B- and -L-sequences do not include a sequence that shares 10 or more contiguous amino acids in common with a human polypeptide sequence.

Particular carrier molecules may comprise a fusion of (i) at least one D3-sub fragment selected from the group consisting of GBS strains 515, H36B, CJB111, 2603, CJB110 and DK21 and (ii) an spb1 polypeptide or fragment thereof. More particularly carrier molecules may comprise a fusion of (i) at least one D3 sub-fragment sequence selected from the group consisting of SEQ ID NO:38, SEQ ID NO:42, SEQ ID NO:40, SEQ ID NO:36, SEQ ID NO:44 and SEQ ID NO:46 and (ii) an spb1 polypeptide of SEQ ID NO:207. Yet more particularly carrier molecules may comprise a fusion of (i) at least one D3 sub-fragment sequence selected from the group consisting of SEQ ID NO:38, SEQ ID NO:42, SEQ ID NO:40, SEQ ID NO:36, SEQ ID NO:44 and SEQ ID NO:46 and (ii) a D2+D3 fragment of the spb1 polypeptide, particularly a fragment comprising or consisting of amino acids 185 to 468 of SEQ ID NO:206.

An exemplary hybrid is carrier GBS59(6XD3)-GBS1523, presented in SEQ ID NO:276. In certain embodiments, the carrier molecule of the invention comprises an amino acid sequence having at least 70% identity (e.g. at least 75%, 80%, 85%, 90%, 91%, 92%, 93%, 94%, 95%, 96%, 97%, 98%, 99%, 99.5%) to SEQ ID NO:276 (as determined across the length of SEQ ID NO:276). In certain such embodiments, the carrier molecule comprises at least one spb1CD4$^+$ T cell epitope and at least one BP-2a CD4$^+$ T cell epitope from each of BP-2a (515), BP-2a (H36B), BP-2a (CJB111), BP-2a (2603), BP-2a (CJB110) and BP-2a (DK21).

The amino acid sequence of SEQ ID NO:276 is shown schematically in FIG. 12. This particular carrier molecule consists of the following parts from N-terminus to C-terminus: N-terminal methionine; D3-sub fragment from 515 (SEQ ID NO:38); GSGS linker (SEQ ID NO:277); D3-sub fragment from H36B (SEQ ID NO:42); GSGS linker (SEQ ID NO:277); D3-sub fragment from CJB111 (SEQ ID NO:40); GSGS linker (SEQ ID NO:277); D3-sub fragment from 2603 (SEQ ID NO:36); GSGS linker (SEQ ID NO:277); D3-sub fragment from CJB110 (SEQ ID NO:44); GSGS linker (SEQ ID NO:277); D3-sub fragment from DK21 (SEQ ID NO:46); GSGGGG linker (SEQ ID NO:272); spb1 with N- and C-terminal deletions (SEQ ID NO:207).

The skilled person will understand that variants of the sequences, and variations in the arrangements, of the polypeptides shown in SEQ ID NO:276 may exhibit the same advantageous carrier characteristics shown in the examples. For example, the sequence of the spb1 polypeptide may be varied, as explained above in the section titled "spb1". Similarly, the number of different BP-2a polypeptides may be varied, and the sequence of each BP-2a polypeptide present may be varied, as explained above in the section titled "BP-2a". In certain embodiments, the carrier comprises at least 1 (i.e. 1, 2, 3, 4, 5, 6, 7 or more) BP-2a polypeptides from different strains. In preferred embodiments, the carrier comprises at least 2 BP-2a polypeptides. Even more preferably, the carrier comprises at least 4, 5, 6 or 7 BP-2a polypeptides from different strains.

The BP-2a and spb1 polypeptides may be present in the carrier molecule in any order. In preferred embodiments, the spb1 polypeptide is towards or is at the C-terminus (i.e. the final —X— is an spb1 polypeptide). In preferred embodiments, all of the BP-2a polypeptides present in the carrier are grouped together and are all either N-terminal or C-terminal to the spb1 polypeptide. Preferably, the hybrid polypeptide can be represented by the formula $NH_2$-A-$\{-X_{BP-2a}-L-\}_n-X_{spb1}$-L-B—COOH, wherein n is at least 1, and is preferably at least 2, and each $X_{BP-2a}$ is derived from a different strain.

The carrier may comprise other polypeptides in addition to the spb1 and BP-2a polypeptides. For example, the carrier may comprise GBS80 and/or GBS67 polypeptides, or homologues or fragments thereof. The amino acid sequence of GBS80 and GBS67 polypeptides are provided in SEQ ID NOs:177-205. GBS80 is also known as SAG0645 identified in Uniprot under Accession No. Q8E0S9 (Cell wall surface anchor family protein).

Hybrid polypeptide may be produced using recombinant fusion protein expression methods, chemical conjugation techniques, or any combination, as described above.

Carrier Molecules Modified to Incorporate Non-Natural Amino Acids

The invention also involves carrier molecules which have been modified to incorporate non-natural amino acids. The non-natural amino acid may be used to conjugate the carrier molecule to another molecule.

In some alternatives, the carrier molecule comprises one or more (e.g. 1, 2, 3, 4, 5, 6, 7, 8, 9, 10 etc.) non-natural amino acids. The non-natural amino acid may have a functional group with a reaction profile that is different to the functional groups available to react in proteins composed of the canonical amino acids (e.g. the amino group of lysine or the sulfhydryl group of cysteine). This in turn means that chemoselective reactions allow site-selective conjugations to be performed at pre-determined sites where a non-natural amino acid has been incorporated into the protein.

For example, the carrier molecule may comprise one or more L-homoallylglycine (HAG) residues. Typically HAG residues are substituted in place of the methionine residues in the sequence. HAG, chemically known as L-2-amino-5-hexenoic acid, is an analogue of methionine, and contains a reactive alkene site. HAG can substitute for methionine in both the initiation and elongation steps of protein synthesis. HAG has an olefinic side-chain which has a different reaction profile to the functional groups found in canonical amino acids, reacting through a thiyl-ene mechanism.

In other embodiments, the carrier molecule may be modified to include other non-natural amino acids which permit site-selective conjugations to be performed at pre-determined sites. For example, the carrier molecule may be modified so that one or more (e.g. 1, 2, 3, 4, 5, etc.) p-acetylphenylalanine residues are included in its sequence. This amino acid has a keto functional group, which is not present in any of the canonical amino acids, and therefore the amino acid can be reacted specifically with hydrazines, alkoxyamines and semicarbazides under mild aqueous conditions to produce hydrazone, oxime and semicarbazone linkages. Other amino acids with keto functional groups include m-acetylphenylalanine and p-benzoylphenylalanine and these residues may be used in the same manner.

In other embodiments, the carrier molecule may be modified to include an azide group (which also does not occur in the canonical amino acids), for example by incorporation of one or more (e.g. 1, 2, 3, 4, 5, etc.) p-azidophenylalanine residues. The azide group can react with an acetylene group on the conjugation partner through a copper (I) catalysed [2+3] cycloaddition reaction. Conversely, it is possible to engineer the non-naturally occurring acetylene group into the carrier protein by incorporation of one or more (e.g. 1, 2, 3, 4, 5, etc.) p-propargyloxyphenylalanine residues, which can then be reacted through the same mechanism with an azide group on the conjugation partner.

In yet further embodiments, the carrier molecule may be modified to include one or more (e.g. 1, 2, 3, 4, 5, etc.) phenylselenocysteine residues. Treatment of this residue with hydrogen peroxide allows its conjugation to thiol groups.

The Antigen

The antigen is typically a saccharide. When the antigen is a saccharide, the saccharide may be any saccharide, particularly a saccharide from a pathogenic organism. Exemplary saccharides for use in the invention are described below. In particular, the saccharide may be a bacterial saccharide, e.g. a bacterial capsular saccharide. Representative bacterial saccharides are described in FIG. 13.

The saccharides may be used in the form of oligosaccharides. These are conveniently formed by fragmentation of purified polysaccharide (e.g. by hydrolysis), which will usually be followed by purification of the fragments of the desired size. Saccharides may be purified from natural sources. Fragmentation of polysaccharides is typically performed to give a final average degree of polymerisation (DP) in the oligosaccharide of less than 30 (e.g. between 10 and 20, around 10 (for example, for serogroup A); between 15 and 25 (for example, for serogroups W135 and Y), around 15-20; between 12 and 22 (for example, for serogroup C); etc.). DP can conveniently be measured by ion exchange chromatography or by colorimetric assays [36].

If hydrolysis is performed, the hydrolysate will generally be sized in order to remove short-length oligosaccharides [37]. This can be achieved in various ways, such as ultrafiltration followed by ion-exchange chromatography. Oligosaccharides with a degree of polymerisation of less than or equal to about 6 are preferably removed (for example, for serogroup A), and those less than around 4 are preferably removed (for example, for serogroups W135 and Y).

Chemical hydrolysis of saccharides generally involves treatment with either acid or base under conditions that are standard in the art. Conditions for depolymerisation of capsular saccharides to their constituent monosaccharides are known in the art. One depolymerisation method involves the use of hydrogen peroxide [38]. Hydrogen peroxide is added to a saccharide (e.g. to give a final $H_2O_2$ concentration of 1%), and the mixture is then incubated (e.g. at around 55° C.) until a desired chain length reduction has been achieved. The reduction over time can be followed by removing samples from the mixture and then measuring the (average) molecular size of saccharide in the sample. Depolymerization can then be stopped by rapid cooling once a desired chain length has been reached.

As an alternative to purification, saccharides may be obtained by total or partial synthesis.

When the antigen is not a saccharide, it may be any other antigen, i.e. any immunogen or hapten. Conjugates of the invention may elicit an immune response against a hapten conjugated to the carrier molecule. The hapten may for example be a drug of abuse [39]. Examples include, but are not limited to, opiates, marijuana, amphetamines, cocaine, barbituates, glutethimide, methyprylon, chloral hydrate, methaqualone, benzodiazepines, LSD, nicotine, anticholinergic drugs, antipsychotic drugs, tryptamine, other psychomimetic drugs, sedatives, phencyclidine, psilocybine, volatile nitrite, and other drugs inducing physical and/or psychological dependence.

Streptococcus agalactiae Capsular Saccharides

Preferred exemplary bacterial capsular saccharides include those from *Streptococcus agalactiae*. The Examples demonstrate that carriers comprising BP-2a polypeptides and spb1 polypeptides may be effective carriers for GBS saccharides. In addition, carriers comprising BP-2a polypeptides and spb1 polypeptides may induce carrier-specific immune responses that provide useful protection.

The GBS capsular saccharide is covalently linked to the peptidoglycan backbone of GBS, and is distinct from the group B antigen, which is another saccharide that is attached to the peptidoglycan backbone.

The GBS capsular saccharides are chemically related, and all GBS capsular saccharides share the following trisaccharide core:

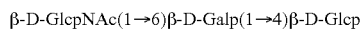

The various GBS serotypes differ by the way in which this core is modified. The difference between serotypes Ia and III, for instance, arises from the use of either the GlcNAc (Ia) or the Gal (III) in this core for linking consecutive trisaccharide cores. Serotypes Ia and Ib both have a [α-D-NeupNAc(2→3)β-D-Galp-(1→] disaccharide linked to the GlcNAc in the core, but the linkage is either 1→4 (Ia) or 1→6 (Ib).

GBS-related disease arises primarily from serotypes Ia, Ib, II, III, IV, V, VI, VII, and VIII, with over 85% being caused by five serotypes: Ia, Ib, II, III & V. The invention may use a saccharide from one or more of these eight serotypes, particularly from one or more of the serotypes selected from the group consisting of Ia, Ib, II, III, IV and V, yet more particularly one or more polysaccharides selected from the group consisting of serotypes Ia, Ib, II, III and V. The capsular saccharides of each of these serotypes include: (a) a terminal N-acetyl-neuraminic acid (NeuNAc) residue (commonly referred to as sialic acid), which in all cases is linked 2→3 to a galactose residue; and (b) a N-acetyl-glucosamine residue (GlcNAc) within the trisaccharide core.

All five saccharides include galactose residues within the trisaccharide core, but serotypes Ia, Ib, II & III also contain additional galactose residues in each repeating unit.

Preferably, the conjugate of the invention comprises a serotype II capsular saccharide or a serotype V capsular saccharide. The Examples demonstrate that the BP-2a/spb1 carriers of the invention may be particularly effective carriers for serotype II capsular saccharide and serotype V, and may be more effective than CRM. In particularly preferred embodiments, the conjugate of the invention comprises a serotype II capsular saccharide. The Examples demonstrate that the BP-2a/spb1 carriers of the invention may be particularly effective carriers for serotype II capsular saccharide.

Saccharides used according to the invention may be in their native form, or may have been modified. For example, the saccharide may be shorter than the native capsular saccharide, or may be chemically modified. In particular, the serotype V capsular saccharide used in the invention may be modified as described in refs. 40 and 41. For example, a serotype V capsular saccharide that has been substantially desialylated. Desialylated GBS serotype V capsular saccharide may be prepared by treating purified GBS serotype V capsular saccharide under mildly acidic conditions (e.g. 0.1M sulphuric acid at 80° C. for 60 minutes) or by treatment with neuraminidase, as described in reference 40. Thus the saccharide used according to the invention may be a substantially full-length capsular polysaccharide, as found in nature, or it may be shorter than the natural length. Full-length polysaccharides may be depolymerised to give shorter fragments for use with the invention e.g. by hydrolysis in mild acid, by heating, by sizing chromatography, etc. In particular, the serotype II and/or III capsular saccharides used in the invention may be depolymerised as described in refs. 42 and 43.

The saccharide may be chemically modified relative to the capsular saccharide as found in nature. For example, the saccharide may be de-O-acetylated (partially or fully), de-N-acetylated (partially or fully), N-propionated (partially or fully), etc. De-acetylation may occur before, during or after conjugation, but preferably occurs before conjugation. Depending on the particular saccharide, de-acetylation may or may not affect immunogenicity. The relevance of O-acetylation on GBS saccharides in various serotypes is discussed in reference 44, and in some embodiments O-acetylation of sialic acid residues at positions 7, 8 and/or 9 is retained before, during and after conjugation e.g. by protection/de-protection, by re-acetylation, etc. However, typically the GBS saccharide used in the present invention has substantially no O-acetylation of sialic acid residues at positions 7, 8 and/or 9. In particular, when the GBS saccharide has been purified by base extraction as described below, then O-acetylation is typically lost. The effect of de-acetylation etc. can be assessed by routine assays.

Capsular saccharides can be purified by known techniques, as described in ref. 45. A typical process involves base extraction, centrifugation, filtration, RNase/DNase treatment, protease treatment, concentration, size exclusion chromatography, ultrafiltration, anion exchange chromatography, and further ultrafiltration. Treatment of GBS cells with the enzyme mutanolysin, which cleaves the bacterial cell wall to free the cell wall components, is also useful.

As an alternative, the purification process described in reference 46 can be used. This involves base extraction, ethanol/CaCl$_2$ treatment, CTAB precipitation, and re-solubilisation. A further alternative process is described in ref. 47.

Neisseria meningitidis Capsular Saccharides

Exemplary capsular saccharides for use with the carriers of the invention include those from *Neisseria meningitidis*. Based on the organism's capsular polysaccharide, various serogroups of *N. meningitidis* have been identified, including A, B, C, H, I, K, L, 29E, W135, X, Y & Z. The saccharide in the invention may be from any of these serogroups. Typically, the saccharide is from one of the following meningococcal serogroups: A, C, W135 and Y.

Serogroups C, W135 and Y

Techniques for preparing capsular polysaccharides from meningococci have been known for many years, and typically involve a process comprising the steps of polysaccharide precipitation (e.g. using a cationic detergent), ethanol fractionation, cold phenol extraction (to remove protein) and ultracentrifugation (to remove LPS) [e.g. see ref. 48].

A more preferred process [49] involves polysaccharide precipitation followed by solubilisation of the precipitated polysaccharide using a lower alcohol. Precipitation can be achieved using a cationic detergent such as tetrabutylammonium and cetyltrimethylammonium salts (e.g. the bromide salts), or hexadimethrine bromide and myristyltrimethylammonium salts. Cetyltrimethylammonium bromide ('CTAB') is particularly preferred [50]. Solubilisation of the precipitated material can be achieved using a lower alcohol such as methanol, propan-1-ol, propan-2-ol, butan-1-ol, butan-2-ol, 2-methyl-propan-1-ol, 2-methyl-propan-2-ol, diols, etc., but ethanol is particularly suitable for solubilising CTAB-polysaccharide complexes. Ethanol may be added to the precipitated polysaccharide to give a final ethanol concentration (based on total content of ethanol and water) of between 50% and 95%.

After re-solubilisation, the polysaccharide may be further treated to remove contaminants. This is particularly important in situations where even minor contamination is not acceptable (e.g. for human vaccine production). This will typically involve one or more steps of filtration e.g. depth filtration, filtration through activated carbon may be used, size filtration and/or ultrafiltration. Once filtered to remove contaminants, the polysaccharide may be precipitated for further treatment and/or processing. This can be conveniently achieved by exchanging cations (e.g. by the addition of calcium or sodium salts). After purification, the capsular saccharides are conjugated to carrier proteins as described below. Further and alternative methods for purification and conjugation of meningococcal saccharides are disclosed in refs. 38 & 51. As an alternative to purification, capsular saccharides of the present invention may be obtained by total or partial synthesis e.g. Hib synthesis is disclosed in ref. 52, and MenA synthesis in ref. 53.

The saccharide may be chemically modified e.g. it may be O-acetylated or de-O-acetylated. Any such de-O-acetylation or hyper-acetylation may be at specific positions in the saccharide. For instance, most serogroup C strains have O-acetyl groups at position C-7 and/or C-8 of the sialic acid residues, but about 15% of clinical isolates lack these O-acetyl groups [54,55]. The acetylation does not seem to affect protective efficacy (e.g. unlike the Menjugate™ product, the NeisVac-C™ product uses a de-O-acetylated saccharide, but both vaccines are effective). The serogroup W135 saccharide is a polymer of sialic acid-galactose disaccharide units. The serogroup Y saccharide is similar to the serogroup W135 saccharide, except that the disaccharide repeating unit includes glucose instead of galactose. Like the serogroup C saccharides, the MenW135 and MenY saccharides have variable O-acetylation, but at sialic acid 7 and 9 positions [56]. Any such chemical modifications preferably take place before conjugation, but may alternatively or additionally take place during conjugation.

Saccharides from different serogroups are preferably purified separately, and may then be combined, either before or after conjugation.

Serogroup A

Conjugates of the invention may include a serogroup A capsular saccharide antigen. The saccharide can be purified and conjugated in the same way as for serogroups C, W135 and Y (see above), although it is structurally different— whereas the capsules of serogroups C, W135 and Y are based around sialic acid (N-acetyl-neuraminic acid, NeuAc), the capsule of serogroup A is based on N-acetyl-mannosamine, which is the natural precursor of sialic acid. The serogroup A saccharide is particularly susceptible to hydrolysis, and its instability in aqueous media means that (a) the immunogenicity of liquid vaccines against serogroup A declines over time, and (b) quality control is more difficult, due to release of saccharide hydrolysis products into the vaccine.

Native MenA capsular saccharide is a homopolymer of (α1→6)-linked N-acetyl-D-mannosamine-1-phosphate, with partial O-acetylation at C3 and C4. The principal glycosidic bond is a 1-6 phosphodiester bond involving the hemiacetal group of C1 and the alcohol group of C6 of the D-mannosamine. The average chain length is 93 monomers. It has the following formula:

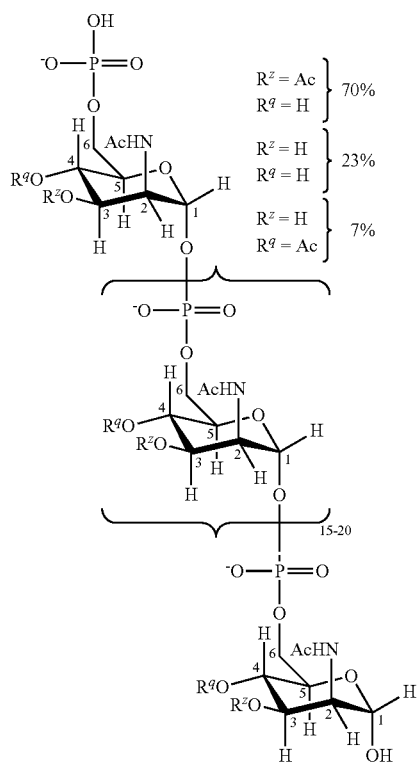

A modified saccharide antigen has been prepared which retains the immunogenic activity of the native serogroup A saccharide but which is much more stable in water. Hydroxyl groups attached at carbons 3 and 4 of the monosaccharide units are replaced by a blocking group [refs. 57 and 58].

The number of monosaccharide units having blocking groups in place of hydroxyls can vary. For example, all or substantially all the monosaccharide units may have blocking groups. Alternatively, at least 10%, 20%, 30%, 40%, 50%, 60%, 70%, 80% or 90% of the monosaccharide units may have blocking groups. At least 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 monosaccharide units may have blocking groups.

Likewise, the number of blocking groups on a monosaccharide unit may vary. For example, the number of blocking groups on any particular monosaccharide unit may be 1 or 2.

The terminal monosaccharide unit may or may not have a blocking group instead of its native hydroxyl. It is preferred to retain a free anomeric hydroxyl group on a terminal monosaccharide unit in order to provide a handle for further reactions (e.g. conjugation). Anomeric hydroxyl groups can be converted to amino groups (—NH$_2$ or —NH-E, where E is a nitrogen protecting group) by reductive amination (using, for example, NaBH$_3$CN/NH$_4$Cl), and can then be regenerated after other hydroxyl groups have been converted to blocking groups.

Blocking groups to replace hydroxyl groups may be directly accessible via a derivatizing reaction of the hydroxyl group i.e. by replacing the hydrogen atom of the hydroxyl group with another group. Suitable derivatives of hydroxyl groups which act as blocking groups are, for example, carbamates, sulfonates, carbonates, esters, ethers (e.g. silyl ethers or alkyl ethers) and acetals. Some specific examples of such blocking groups are allyl, alloc, benzyl, BOM, t-butyl, trityl, TBS, TBDPS, TES, TMS, TIPS, PMB, MEM, MOM, MTM, THP, etc. Other blocking groups that are not directly accessible and which completely replace the hydroxyl group include $C_{1-12}$ alkyl, $C_{3-12}$ alkyl, $C_{5-12}$ aryl, $C_{5-12}$ aryl-$C_{1-6}$ alkyl, $NR^1R^2$ ($R^1$ and $R^2$ are defined in the following paragraph), H, F, Cl, Br, $CO_2H$, $CO_2(C_{1-6}$ alkyl), CN, $CF_3$, $CCl_3$, etc.

Typical blocking groups are of the formula: —O—X—Y or —$OR^3$ wherein: X is C(O), S(O) or $SO_2$; Y is $C_{1-12}$ alkyl, $C_{1-12}$ alkoxy, $C_{3-12}$ cycloalkyl, $C_{5-12}$ aryl or $C_{5-12}$ aryl-$C_{1-6}$ alkyl, each of which may optionally be substituted with 1, 2 or 3 groups independently selected from F, Cl, Br, $CO_2H$, $CO_2(C_{1-6}$ alkyl), CN, $CF_3$ or $CCl_3$; or Y is $NR^1R^2$; $R^1$ and $R^2$ are independently selected from H, $C_{1-12}$ alkyl, C3-12 cycloalkyl, $C_5$-12 aryl, $C_{5-12}$ aryl-$C_{1-6}$ alkyl; or $R^1$ and $R^2$ may be joined to form a $C_{3-12}$ saturated heterocyclic group; $R^3$ is $C_{1-12}$ alkyl or $C_{3-12}$ cycloalkyl, each of which may optionally be substituted with 1, 2 or 3 groups independently selected from F, Cl, Br, $CO_2(C_{1-6}$ alkyl), CN, $CF_3$ or $CCl_3$; or $R^3$ is $C_{5-12}$ aryl or $C_{5-12}$ aryl-$C_{1-6}$ alkyl, each of which may optionally be substituted with 1, 2, 3, 4 or 5 groups selected from F, Cl, Br, $CO_2H$, $CO_2(C_{1-6}$ alkyl), CN, $CF_3$ or $CCl_3$. When $R^3$ is C1-12 alkyl or C3-12 cycloalkyl, it is typically substituted with 1, 2 or 3 groups as defined above. When $R^1$ and $R^2$ are joined to form a $C_{3-12}$ saturated heterocyclic group, it is meant that $R^1$ and $R^2$ together with the nitrogen atom form a saturated heterocyclic group containing any number of carbon atoms between 3 and 12 (e.g. $C_3$, $C_4$, $C_5$, $C_6$, $C_7$, $C_8$, $C_9$, $C_{10}$, $C_{11}$, $C_{12}$). The heterocyclic group may contain 1 or 2 heteroatoms (such as N, O or S) other than the nitrogen atom. Examples of $C_{3-12}$ saturated heterocyclic groups are pyrrolidinyl, piperidinyl, morpholinyl, piperazinyl, imidazolidinyl, azetidinyl and aziridinyl.

Blocking groups —O—X—Y and —$OR^3$ can be prepared from —OH groups by standard derivatizing procedures, such as reaction of the hydroxyl group with an acyl halide, alkyl halide, sulfonyl halide, etc. Hence, the oxygen atom in —O—X—Y is usually the oxygen atom of the hydroxyl group, while the —X—Y group in —O—X—Y usually replaces the hydrogen atom of the hydroxyl group.

Alternatively, the blocking groups may be accessible via a substitution reaction, such as a Mitsonobu-type substitution. These and other methods of preparing blocking groups from hydroxyl groups are well known.

Specific blocking groups for use in the invention are —$OC(O)CF_3$ [59] and a carbamate group $OC(O)NR^1R^2$, where $R^1$ and $R^2$ are independently selected from $C_{1-6}$ alkyl. Typically, $R^1$ and $R^2$ are both methyl i.e. the blocking group is —$OC(O)NMe_2$. Carbamate blocking groups have a stabilizing effect on the glycosidic bond and may be prepared under mild conditions.

A particularly preferred blocking group is —$OC(O)CH_3$ [58]. The proportion of 4- and/or 3-positions in the modified *N. meningitidis* serogroup A saccharide that have this blocking group may vary. For example, the proportion of 4-positions that have blocking groups may be about 0%, at least 10%, 20%, 30%, 40%, 50%, 60%, 70%, 80%, 90%, 95% or about 100%, with at least 80% and about 100% being preferred. Similarly, the proportion of 3-positions that have blocking groups may be about 0%, at least 10%, 20%, 30%, 40%, 50%, 60%, 70%, 80%, 90%, 95% or about 100%, with at least 80% and about 100% being preferred. Typically, the proportion of 4- and 3-positions that have blocking groups is about the same at each position. In other words, the ratio of 4-positions that have blocking groups to 3-positions that have blocking groups is about 1:1. However, in some embodiments, the proportion of 4-positions that have blocking groups may vary relative to the proportion of 3-positions that have blocking groups. For example, the ratio of 4-positions that have blocking groups to 3-positions that have blocking groups may be 1:20, 1:19, 1:18, 1:17, 1:16, 1:15, 1:14, 1:13, 1:12, 1:11, 1:10, 1:9, 1:8, 1:7, 1:6, 1:5, 1:4, 1:3 or 1:2. Similarly, the ratio of 3-positions that have blocking groups to 4-positions that have blocking groups may be 1:20, 1:19, 1:18, 1:17, 1:16, 1:15, 1:14, 1:13, 1:12, 1:11, 1:10, 1:9, 1:8, 1:7, 1:6, 1:5, 1:4, 1:3 or 1:2.

Typical modified MenA saccharides contain n monosaccharide units, where at least h % of the monosaccharide units do not have —OH groups at both of positions 3 and 4. The value of h is 24 or more (e.g. 25, 26, 27, 28, 29, 30, 35, 40, 45, 50, 55, 60, 65, 70, 75, 80, 85, 90, 95, 98, 99 or 100) and is usually 50 or more. The absent —OH groups are blocking groups as defined above.

Other typical modified MenA saccharides comprise monosaccharide units, wherein at least s of the monosaccharide units do not have —OH at the 3 position and do not have —OH at the 4 position. The value of s is at least 1 (e.g. 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90). The absent —OH groups are blocking groups as defined above.

Suitable modified MenA saccharides for use with the invention have the formula:

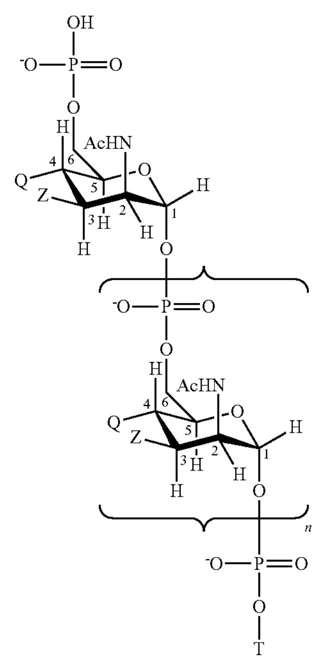

wherein n is an integer from 1 to 100 (particularly an integer from 5 to 25, usually 15-25);

T is of the formula (A) or (B):

(A)

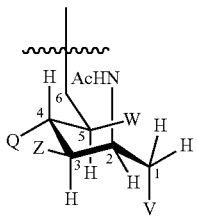
(B)

each Z group is independently selected from OH or a blocking group as defined above; and each Q group is independently selected from OH or a blocking group as defined above;

Y is selected from OH or a blocking group as defined above;

E is H or a nitrogen protecting group;
and wherein more than about 7% (e.g. 8%, 9%, 10% or more) of the Q groups are blocking groups. In some embodiments, the hydroxyl group attached at carbon 1 in formula (A) is replaced by a blocking group as defined above. In some embodiments, E in formula (B) is a linker or a carrier molecule of the invention. When E is a linker, the linker may be covalently bonded to a carrier molecule of the invention.

Each of the n+2 Z groups may be the same or different from each other. Likewise, each of the n+2 Q groups may be the same or different from each other. All the Z groups may be OH. Alternatively, at least 10%, 20, 30%, 40%, 50% or 60% of the Z groups may be OAc. Typically, about 70% of the Z groups are OAc, with the remainder of the Z groups being OH or blocking groups as defined above. At least about 7% of Q groups are blocking groups. Typically, at least 10%, 20%, 30%, 40%, 50%, 60%, 70%, 80%, 90% or even 100% of the Q groups are blocking groups.

Glucans

The saccharide may be a glucan. Glucans are glucose-containing polysaccharides found inter alia in fungal cell walls. The α-glucans include one or more α-linkages between glucose subunits, whereas β-glucans include one or more β-linkages between glucose subunits. The glucan used in accordance with the invention includes β linkages, and may contain only β linkages (i.e. no αlinkages).

The glucan may comprise one or more β-1,3-linkages and/or one or more β-1,6-linkages. It may also comprise one or more β-1,2-linkages and/or β-1,4-linkages, but normally its only β linkages will be β-1,3-linkages and/or β-1,6-linkages. The glucan may be branched or linear.

Full-length native β-glucans are insoluble and have a molecular weight in the megadalton range. It is preferred to use soluble glucans in conjugates of the invention. Solubilisation may be achieved by fragmenting long insoluble glucans. This may be achieved by hydrolysis or, more conveniently, by digestion with a glucanase (e.g. with a β-1,3-glucanase or a β-1,6-glucanase). As an alternative, short glucans can be prepared synthetically by joining monosaccharide building blocks.

Low molecular weight glucans are preferred, particularly those with a molecular weight of less than 100 kDa (e.g. less than 80, 70, 60, 50, 40, 30, 25, 20, or 15 kDa). It is also possible to use oligosaccharides e.g. containing 60 or fewer (e.g. 59, 58, 57, 56, 55, 54, 53, 52, 51, 50, 49, 48, 47, 46, 45, 44, 43, 42, 41, 40 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4) glucose monosaccharide units. Within this range, oligosaccharides with between 10 and 50 or between 20 and 40 monosaccharide units are preferred.

The glucan may be a fungal glucan. A 'fungal glucan' will generally be obtained from a fungus but, where a particular glucan structure is found in both fungi and non-fungi (e.g. in bacteria, lower plants or algae) then the non-fungal organism may be used as an alternative source. Thus the glucan may be derived from the cell wall of a *Candida*, such as *C. albicans*, or from *Coccidioides immitis*, *Trichophyton verrucosum*, *Blastomyces dermatidis*, *Cryptococcus neoformans*, *Histoplasma capsulatum*, *Saccharomyces cerevisiae*, *Paracoccidioides brasiliensis*, or *Pythiumn insidiosum*.

There are various sources of fungal β-glucans. For instance, pure β-glucans are commercially available e.g. pustulan (Calbiochem) is a β-1,6-glucan purified from *Umbilicaria papullosa*. β-glucans can be purified from fungal cell walls in various ways. Reference 60, for instance, discloses a two-step procedure for preparing a water-soluble β-glucan extract from *Candida*, free from cell-wall mannan, involving NaClO oxidation and DMSO extraction. The resulting product ('Candida soluble β-D-glucan' or 'CSBG') is mainly composed of a linear β-1,3-glucan with a linear β-1,6-glucan moiety. Similarly, reference 61 discloses the production of GG-zym from *C. albicans*. Such glucans from *C. albicans*, include (a) β-1,6-glucans with β-1,3-glucan lateral chains and an average degree of polymerisation of about 30, and (b) β-1,3-glucans with β-1,6-glucan lateral chains and an average degree of polymerisation of about 4.

In some embodiments of the invention, the glucan is a β-1,3 glucan with some β-1,6 branching, as seen in e.g. laminarins. Laminarins are found in brown algae and seaweeds. The β(1-3):β(1-6) ratios of laminarins vary between different sources e.g. it is as low as 3:2 in *Eisenia bicyclis* laminarin, but as high as 7:1 in *Laminaria digititata* laminarin [62]. Thus the glucan used with the invention may have a β(1-3):β(1-6) ratio of between 1.5:1 and 7.5:1 e.g. about 2:1, 3:1, 4:1, 5:1, 6:1 or 7:1. Optionally, the glucan may have a terminal mannitol subunit, e.g. a 1,1-α-linked mannitol residue [63]. The glucan may also comprise mannose subunits.

In other embodiments, the glucan has exclusively or mainly β-1,3 linkages, as seen in curdlan. These glucans may elicit better protection than glucans comprising other linkages, particularly glucans comprising β-1,3 linkages and a greater proportion of β-1,6 linkages. Thus the glucan may be made solely of β-1,3-linked glucose residues (e.g. linear β-D-glucopyranoses with exclusively 1,3 linkages). Optionally, though, the glucan may include monosaccharide residues that are not β-1,3-linked glucose residues e.g. it may include β-1,6-linked glucose residues. The ratio of β-1,3-finked glucose residues to these other residues should be at least 8:1 (e.g. ≥9:1, ≥10:1, ≥11:1, ≥12:1, ≥13:1, ≥14:1, ≥15:1, ≥16:1, ≥17:1, ≥18:1, ≥19:1, ≥20:1, ≥25:1, ≥30:1, ≥35:1, ≥40:1, ≥45:1, ≥50:1, ≥75:1, ≥100:1, etc.) and/or there are one or more (e.g. ≥1, ≥2, ≥3, ≥4, ≥5, ≥6, ≥7, ≥8, ≥9, ≥10, ≥11, ≥12, etc.) sequences of at least five (e.g. ≥5, ≥6, ≥7, ≥8, ≥9, ≥10, ≥11, ≥12, ≥13, ≥14, ≥15, ≥16, ≥17, ≥18, ≥19, ≥20, ≥30, ≥40, ≥50, ≥60, etc.) adjacent non-terminal residues linked to other residues only by β-1,3 linkages. By "non-terminal" it is meant that the residue is not present at a free end of the glucan. In some embodiments, the adjacent non-terminal residues may not include any residues coupled to a carrier molecule, linker or other spacer as described below. The presence of five adjacent non-terminal residues linked to other residues only by β-1,3 linkages may provide a protective antibody response, e.g. against *C. albicans*.

In further embodiments, a conjugate may include two different glucans e.g. a first glucan having a β(1-3):β(1-6) ratio of between 1.5:1 and 7.5:1, and a second glucan having exclusively or mainly β-1,3 linkages. For instance a conjugate may include both a laminarin glucan and a curdlan glucan.

Where a β-glucan includes both β-1,3 and β-1,6 linkages at a desired ratio and/or sequence then this glucan may be found in nature (e.g. a laminarin), or it may be made artificially. For instance, it may be made by chemical synthesis, in whole or in part. Methods for the chemical synthesis of β-1,3/β-1,6 glucans are known, for example from references 64-74. β-glucan including both β-1,3 and β-1,6 linkages at a desired ratio may also be made starting from an available glucan and treating it with a β-1,6-glucanase (also known as glucan endo-1,6-β-glucosidase, 1,6-β-D-glucan glucanohydrolase, etc.; EC 3.2.1.75) or a β-1,3-glucanase (such as an exo-1,3-glucanase (EC 3.2.1.58) or an endo-1,3-glucanase (EC 3.2.1.39) until a desired ratio and/or sequence is reached.

When a glucan containing solely β-1,3-linked glucose is desired then β-1,6-glucanase treatment may be pursued to completion, as β-1,6-glucanase will eventually yield pure β-1,3 glucan. More conveniently, however, a pure β-1,3-glucan may be used. These may be made synthetically, by chemical and/or enzymatic synthesis e.g. using a (1→3)-β-D-glucan synthase, of which several are known from many organisms (including bacteria, yeasts, plants and fungi). Methods for the chemical synthesis of β-1,3 glucans are known, for example from references 75-78. As a useful alternative to synthesis, a natural β-1,3-glucan may be used, such as a curdlan (linear β-1,3-glucan from an *Agrobacterium* previously known as *Alcaligenes faecalis* var. *myxogenes*; commercially available e.g. from Sigma-Aldrich catalog C7821) or paramylon (β-1,3-glucan from *Euglena*). Organisms producing high levels of β-1,3-glucans are known in the art e.g. the *Agrobacterium* of refs. 79 & 80, or the *Euglena gracilis* of ref. 81.

Laminarin and curdlan are typically found in nature as high molecular weight polymers e.g. with a molecular weight of at least 100 kDa. They are often insoluble in aqueous media. In their natural forms, therefore, they are not well suited to immunisation. Thus the invention may use a shorter glucan e.g. those containing 60 or fewer glucose monosaccharide units (e.g. 59, 58, 57, 56, 55, 54, 53, 52, 51, 50, 49, 48, 47, 46, 45, 44, 43, 42, 41, 40 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4). A glucan having a number of glucose residues in the range of 2-60 may be used e.g. between 10-50 or between 20-40 glucose units. A glucan with 25-30 glucose residues is particularly useful. Suitable glucans may be formed e.g. by acid hydrolysis of a natural glucan, or by enzymatic digestion e.g. with a glucanase, such as a β-1,3-glucanase. A glucan with 11-19, e.g. β-19 and particularly 15 or 17, glucose monosaccharide units is also useful. In particular, glucans with the following structures (A) or (B) are specifically envisaged for use in the present invention:

(A)

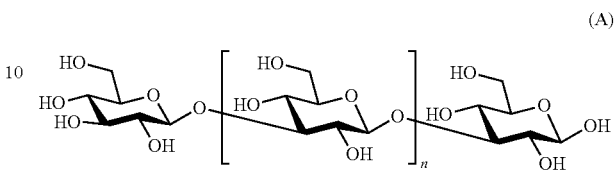

wherein n+2 is in the range of 2-60, e.g. between 10-50 or between 2-40. Preferably, n+2 is in the range of 25-30 or 11-19, e.g. 13-17. The inventors have found that n+2=15 is suitable.

(B)

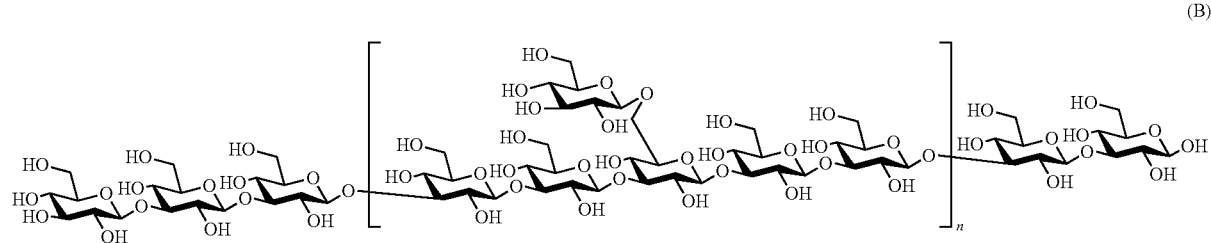

wherein n is in the range of 0-9, e.g. between 1-7 or between 2-6. Preferably, n is in the range of 3-4 or 1-3. The inventors have found that n=2 is suitable.

In some embodiments, the glucan is a single molecular species. In these embodiments, all of the glucan molecules are identical in terms of sequence. Accordingly, all of the glucan molecules are identical in terms of their structural properties, including molecular weight etc. Typically, this form of glucan is obtained by chemical synthesis, e.g. using the methods described above. For example, reference 76 describes the synthesis of a single β-1,3 linked species. Alternatively, in other embodiments, the glucan may be obtained from a natural glucan, e.g. a glucan from *Laminaria digitata*, *Agrobacterium* or *Euglena* as described above, with the glucan being purified until the required single molecular species is obtained. Natural glucans that have been purified in this way are commercially available. A glucan that is a single molecular species may be identified by measuring the polydispersity (Mw/Mn) of the glucan sample. This parameter can conveniently be measured by SEC-MALLS, for example as described in reference 82. Suitable glucans for use in this embodiment of the invention have a polydispersity of about 1, e.g. 1.01 or less. Solubility of natural glucans, such as curdlan, can be increased by introducing ionic groups (e.g. by sulfation, particularly at O-6 in curdlan). Such modifications may be used with the invention, but are ideally avoided as they may alter the glucan's antigenicity. When the saccharide is a glucan, it is typically a laminarin.

*Streptococcus pneumoniae* Capsular Saccharides

As discussed above, the saccharide may also be a bacterial capsular saccharide. Further exemplary bacterial capsular saccharides include those from *Streptococcus pneumoniae*.

When the saccharide is a capsular saccharides from *S. pneumoniae*, it is typically from one of the following pneumococcal serotypes: 1, 2, 3, 4, 5, 6A, 6B, 7F, 8, 9N, 9V, 10A, 11A, 12F, 14, 15B, 17F, 18C, 19A, 19F, 20, 22F, 23F and 33F, preferably from 1, 5, 6B, 14, 19F and 23F. Capsular polysaccharides from *S. pneumoniae* comprise repeating oligosaccharide units which may contain up to 8 sugar residues. The oligosaccharide units for the main *S. pneumoniae* serotypes are described in and refs 83 and 84.

*Staphylococcus aureus* Capsular Saccharides

Further exemplary bacterial capsular saccharides include those from *Staphylococcus aureus*, particularly the capsular polysaccharides of *S. aureus* type 5 and type 8. The structures of type 5 and type 8 capsular polysaccharides were described in references 85 and 86 as:

Type 5:→4)-β-D-ManNAcA(3OAc)-(1→4)-α-L-FucNAc(1→3)-β-D-FucNAc-(1→

Type 8:→3)-β-D-ManNAcA(4OAc)-(1→3)-α-L-FucNAc(1→3)-β-D-FucNAc-(1→

Recent NMR spectroscopy data [87] has led to a revision of these structures to:

Type 5:→4)-β-D-ManNAcA-(1→4)-α-L-FucNAc(3OAc)-(1→3)-β-D-FucNAc-(1→

Type 8:→3)-β-D-ManNAcA(4OAc)-(1→3)-α-L-FucNAc(1→3)-α-D-FucNAc(1→

The polysaccharide may be chemically modified relative to the capsular polysaccharide as found in nature.

For example, the polysaccharide may be de-O-acetylated (partially or fully), de-N-acetylated (partially or fully), N-propionated (partially or fully), etc. De-acetylation may occur before, during or after conjugation, but typically occurs before conjugation. Depending on the particular polysaccharide, de-acetylation may or may not affect immunogenicity e.g. the NeisVac-C™ vaccine uses a de-O-acetylated polysaccharide, whereas Menjugate™ is acetylated, but both vaccines are effective. The effect of de-acetylation etc. can be assessed by routine assays. For example, the relevance of O-acetylation on *S. aureus* type 5 or type 8 capsular polysaccharides is discussed in reference 88. The native polysaccharides are said in this document to have 75% O-acetylation. These polysaccharides induced antibodies to both the polysaccharide backbone and O-acetyl groups. Polysaccharides with 0% O-acetylation still elicited antibodies to the polysaccharide backbone. Both types of antibody were opsonic against *S. aureus* strains that varied in their O-acetyl content. Accordingly, the type 5 or type 8 capsular polysaccharides used in the present invention may have between 0 and 100% O-acetylation.

The degree of O-acetylation of the polysaccharide can be determined by any method known in the art, for example, by proton NMR (e.g. as described in references 89, 90, 91 or 92). A further method is described in reference 93. Similar methods may be used to determine the degree of N-acetylation of the polysaccharide. O-acetyl groups may be removed by hydrolysis, for example by treatment with a base such as anhydrous hydrazine [94] or NaOH [88]. Similar methods may be used to remove N-acetyl groups. To maintain high levels of O-acetylation on type 5 and/or 8 capsular polysaccharides, treatments that lead to hydrolysis of the O-acetyl groups are minimised, e.g. treatments at extremes of pH.

Capsular polysaccharides can be purified by known techniques, as described in the references herein. A typical process involves phenol-ethanol inactivation of *S. aureus* cells, centrifugation, lysostaphin treatment, RNase/DNase treatment, centrifugation, dialysis, protease treatment, further dialysis, filtration, precipitation with ethanol/CaCl$_2$, dialysis, freeze-drying, anion exchange chromatography, dialysis, freeze-drying, size exclusion chromatography, dialysis and freeze-drying [95]. An alternative process involves autoclaving *S. aureus* cells, ultrafiltration of the polysaccharide-containing supernatant, concentration, lyophilisation, treatment with sodium metaperiodate to remove teichoic acid, further ultrafiltration, diafiltration, high performance size exclusion liquid chromatography, dialysis and freeze-drying [96].

The invention is not limited to polysaccharides purified from natural sources, however, and the polysaccharides may be obtained by other methods, such as total or partial synthesis.

Other Bacterial Capsular Saccharides

Further exemplary bacterial capsular saccharides include those from *Haemophilus influenzae* Type b, *Salmonella enterica* Typhi Vi and *Clostridium difficile*.

*Streptococcus pyogenes* Carbohydrate

The invention may also use non-capsular bacterial saccharides. An exemplary non-capsular bacterial saccharide is the *Streptococcus pyogenes* GAS carbohydrate (also known as the GAS cell wall polysaccharide, or GASP). This saccharide features a branched structure with an L-rhamnopyranose (Rhap) backbone consisting of alternating alpha-(1→2) and alpha-(1-6) links and D-N-acetylglucosamine (GlcpNAc) residues beta-(1→3)-connected to alternating rhamnose rings ([97]).

The GAS carbohydrate will generally be in its native form, but it may have been modified. For example, the saccharide may be shorter than the native GAS carbohydrate, or may be chemically modified.

Thus the saccharide used according to the invention may be a substantially full-length GAS carbohydrate, as found in nature, or it may be shorter than the natural length. Full-length polysaccharides may be depolymerised to give shorter fragments for use with the invention e.g. by hydrolysis in mild acid, by heating, by sizing chromatography, etc. A short fragment thought to correspond to the terminal unit on the GAS carbohydrate has been proposed for use in a vaccine [98]. Accordingly, short fragments are envisaged in the present invention. However, it is preferred to use saccharides of substantially full-length. The GAS carbohydrate typically has a molecular weight of about 10, in particular about 7.5-8.5 kDa. Molecular masses can be measured by HPLC, for example SEC-HPLC using a TSK Gel G3000SW column (Sigma) relative to pullulan standards, such as those available from Polymer Standard Service [99]. The saccharide may be chemically modified relative to the GAS carbohydrate as found in nature. For example, the saccharide may be de-N-acetylated (partially or fully), N-propionated (partially or fully), etc. The effect of de-acetylation etc., for example on immunogenicity, can be assessed by routine assays.

Production of Type II and Type V Saccharide Conjugates

Capsular saccharides may be purified by known techniques, for example as described in Wessels et al. (J Clin Invest, 1990 86:1428-33) or Wessels et al. (Infect Immun 1989, 57:1089-94). A typical purification process involves base extraction, centrifugation, filtration, RNase/DNase treatment, protease treatment, concentration, size exclusion chromatography, ultrafiltration, anion exchange chromatography, and further ultrafiltration. Treatment of GBS cells with the enzyme mutanolysin, which cleaves the bacterial cell wall to free the cell wall components, is also useful.

As an alternative, the purification process described in WO2006/082527 can be used. This involves base extraction, ethanol/CaCl$_2$ treatment, CTAB precipitation, and re solubilisation. Further extraction and purification processes are known in the art, such as those described in WO 2009/081276.

The Conjugate

The invention involves a conjugate comprising an antigen and a carrier molecule, wherein the carrier molecule comprises a spb1 polypeptide and at least one BP-2a polypeptide. Particularly the carrier molecule is a fusion protein which comprises an spb1 polypeptide and at least one BP-2a polypeptide, at least two BP-2a polypeptides, particularly three, four, five, six or seven BP-2a polypeptides or fragments thereof.

The carrier molecule may be covalently conjugated to the antigen directly or via a linker. Any suitable conjugation reaction can be used, with any suitable linker where desired.

Attachment of the antigen to the carrier is preferably via a —$NH_2$ group e.g. in the side chain of a lysine residue in a carrier protein, or of an arginine residue. Where the antigen has a free aldehyde group, then this can react with an amine in the carrier to form a conjugate by reductive amination.

Attachment to the carrier may also be via a —SH group e.g. in the side chain of a cysteine residue. Alternatively the antigen may be attached to the carrier via a linker molecule.

The antigen will typically be activated or functionalised prior to conjugation. Activation may involve, for example, cyanylating reagents such as CDAP (e.g. 1-cyano-4-dimethylamino pyridinium tetrafluoroborate [100, 101, etc.]). Other suitable techniques use carbodiimides, hydrazides, active esters, norborane, p-nitrobenzoic acid, N-hydroxysuccinimide, S-NHS, EDC, TSTU (see also the introduction to reference 7).

Direct linkages to the protein may comprise oxidation of the antigen followed by reductive amination with the protein, as described in, for example, refs. 102 and 103.

Linkages via a linker group may be made using any known procedure, for example, the procedures described in refs. 104 and 105. Typically, the linker is attached via the anomeric carbon of a saccharide antigen. A preferred type of linkage is an adipic acid linker, which may be formed by coupling a free —$NH_2$ group (e.g. introduced to a saccharide by amination) with adipic acid (using, for example, diimide activation), and then coupling a protein to the resulting antigen-adipic acid intermediate [5, 106, 107]. A similar preferred type of linkage is a glutaric acid linker, which may be formed by coupling a free —$NH_2$ group with glutaric acid in the same way. Adipid and glutaric acid linkers may also be formed by direct coupling to the antigen, i.e. without prior introduction of a free group, e.g. a free —$NH_2$ group, to the antigen, followed by coupling a protein to the resulting antigen-adipic/glutaric acid intermediate. Another preferred type of linkage is a carbonyl linker, which may be formed by reaction of a free hydroxyl group of a modified antigen with CDI [108, 109] followed by reaction with a protein to form a carbamate linkage. Other linkers include β-propionamido [110], nitrophenyl-ethylamine [111], haloacyl halides [112], glycosidic linkages [113], 6-aminocaproic acid [114], N-succinimidyl-3-(2-pyridyldithio)-propionate (SPDP) [115], adipic acid dihydrazide ADH [116], C4 to C12 moieties [117], etc. Carbodiimide condensation can also be used [118].

A bifunctional linker may be used to provide a first group for coupling to an amine group in the antigen (e.g. introduced to the antigen by amination) and a second group for coupling to the carrier (typically for coupling to an amine in the carrier). Alternatively, the first group is capable of direct coupling to the antigen, i.e. without prior introduction of a group, e.g. an amine group, to the antigen.

In some embodiments, the first group in the bifunctional linker is thus able to react with an amine group (—$NH_2$) on the antigen. This reaction will typically involve an electrophilic substitution of the amine's hydrogen. In other embodiments, the first group in the bifunctional linker is able to react directly with the antigen. In both sets of embodiments, the second group in the bifunctional linker is typically able to react with an amine group on the carrier. This reaction will again typically involve an electrophilic substitution of the amine.

Where the reactions with both the antigen and the carrier involve amines then it is preferred to use a bifunctional linker. For example, a homobifunctional linker of the formula X-L-X may be used, where: the two X groups are the same as each other and can react with the amines; and where L is a linking moiety in the linker. Similarly, a heterobifunctional linker of the formula X-L-X may be used, where: the two X groups are different and can react with the amines; and where L is a linking moiety in the linker. A preferred X group is N-oxysuccinimide. L preferably has formula L'-$L^2$-L', where L' is carbonyl. Preferred $L^2$ groups are straight chain alkyls with 1 to 10 carbon atoms (e.g. $C_1$, $C_2$, $C_3$, $C_4$, $C_5$, $C_6$, $C_7$, $C_8$, $C_9$, $C_{10}$) e.g. —$(CH_2)_4$— or —$(CH_2)_3$—.

Similarly, where the reaction with the antigen involves direct coupling and the reaction with the carrier involves an amine then it is also preferred to use a bifunctional linker. For example, a homobifunctional linker of the formula X-L-X may be used, where: the two X groups are the same as each other and can react with the antigen/amine; and where L is a linking moiety in the linker. Similarly, a heterobifunctional linker of the formula X-L-X may be used, where: the two X groups are different and one can react with the antigen while the other can react with the amine; and where L is a linking moiety in the linker. A preferred X group is N-oxysuccinimide. L preferably has formula L'-$L^2$-L', where L' is carbonyl. Preferred $L^2$ groups are straight chain alkyls with 1 to 10 carbon atoms (e.g. $C_1$, $C_2$, $C_3$, $C_4$, $C_5$, $C_6$, $C_7$, $C_8$, $C_9$, $C_{10}$) e.g. —$(CH_2)_4$— or —$(CH_2)_3$—.

Other X groups for use in the bifunctional linkers described in the two preceding paragraphs are those which form esters when combined with HO-L-OH, such as norborane, p-nitrobenzoic acid, and sulfo-N-hydroxysuccinimide. Further bifunctional linkers for use with the invention include acryloyl halides (e.g. chloride) and haloacylhalides.

The linker will generally be added in molar excess to antigen during coupling to the antigen.

When the antigen has a single group that is linked to the carrier molecule (optionally via a linker), and the carrier has multiple groups that are linked to different antigen/linker molecules, the resultant conjugate may form a "star" structure. This structure comprises a central carrier molecule with multiple antigen molecules radiating from the carrier (optionally via linkers). When the antigen has more than one group that is linked to the carrier molecule (optionally via a linker), and the carrier has more than one group that is linked to different antigen/linker molecules, the resultant conjugate may form a "net" structure. This structure comprises a network of carrier molecules connected by antigen molecules (optionally via linkers).

Conjugates may have excess carrier (w/w) or excess antigen (w/w) e.g. in the ratio range of 1:5 to 5:1. Conjugates with excess carrier protein are typical e.g. in the range 0.2:1 to 0.9:1, or equal weights. The conjugate may include small amounts of free (i.e. unconjugated) carrier. When a given carrier protein is present in both free and conjugated form in a composition of the invention, the unconjugated form is preferably no more than 5% of the total amount of the carrier protein in the composition as a whole, and more preferably present at less than 2% (by weight).

When the conjugate is comprised within a pharmaceutical composition of the invention, the composition may also comprise free carrier protein as immunogen [119].

After conjugation, free and conjugated antigens can be separated. There are many suitable methods e.g. hydrophobic chromatography, tangential ultrafiltration, diafiltration, etc. [see also refs. 120, 121 etc.]. Tangential flow ultrafiltration is preferred.

A saccharide moiety in the conjugate is preferably a low molecular weight saccharide or an oligosaccharide, as defined above. Oligosaccharides will typically be sized prior to conjugation.

The conjugate is preferably soluble in water and/or in a physiological buffer.

Conjugation

The invention involves conjugates that are capsular saccharides from GBS serotypes Ia, Ib, II, III and V, each conjugated to a carrier protein. In general, covalent conjugation of saccharides to carriers enhances the immunogenicity of saccharides as it converts them from T-independent antigens to T-dependent antigens, thus allowing priming for immunological memory. Conjugation is particularly useful for paediatric vaccines and is a well-known technique. Conjugation of GBS saccharides has been widely reported e.g. see Paoletti et al. (1990) J Biol Chem 265:18278-83. Although polysaccharides are immunogenic, conjugation of polysaccharides to carrier proteins can improve or enhance immunogenicity. Therefore, as used herein, the term "carrier" refers to an immunogenic substance which, when conjugated to an antigen (such as a polysaccharide) and administered to a suitable animal, will induce or enhance an immune response in the animal, particularly a protective immune response, and elicit the production of antibodies that bind specifically to the antigen, for example, the above described polysaccharides. The typical prior art process for GBS saccharide conjugation typically involves reductive amination of a purified saccharide to a carrier protein such as tetanus toxoid (TT) or CRM197 Wessels et al. (1990) J Clin Invest 86:1428-33. The reductive amination involves an amine group on the side chain of an amino acid in the carrier and an aldehyde group in the saccharide. As GBS capsular saccharides do not include an aldehyde group in their natural form then this is typically generated before conjugation by oxidation (e.g. periodate oxidation) of a portion (e.g. between 5 and 40%, particularly between 10 and 30%, preferably about 20%) of the saccharide's sialic acid residues. Conjugate vaccines prepared in this manner have been shown to be safe and immunogenic in humans for each of GBS serotypes Ia, Ib, II, III, and V, Paoletti & Kasper (2003) Expert Opin Biol Ther 3:975-84. Typically, all of the conjugates in the immunogenic compositions of the present invention may be prepared in this manner. However, when the invention uses a serotype V capsular saccharide that is desialylated, then an aldehyde group may be generated in this saccharide before conjugation by oxidation (e.g. periodate oxidation) of a portion (e.g. between 5 and 40%, particularly between 10 and 30%, preferably about 20%) of the saccharide's galactose residues. An alternative conjugation process involves the use of —$NH_2$ groups in the saccharide (either from de-N-acetylation, or after introduction of amines) in conjunction with bifunctional linkers. In some embodiments, one or more of the conjugates in the immunogenic compositions of the present invention may be prepared in this manner. A further alternative process utilises free aldehyde groups of terminal 2,5-anhydro-D-mannose residues from depolymerization of type II or type III capsular saccharides by mild deaminative cleavage are used for conjugation by reductive amination. In some embodiments, one or more of the conjugates in the immunogenic compositions of the present invention may be prepared in this manner. In some embodiments, the carrier and antigen may be conjugated by sortase mediated ligation, for example, as described in WO13065009 or WO13003555.

Protein-Protein Conjugation

Conjugates of the invention may comprise utilise protein-protein conjugation and may comprise proteins conjugated to proteins. In particular, the BP-2a polypeptide may be conjugated to the spb1 polypeptide. Alternatively, or in addition, the protein carrier molecule of the invention may be conjugated to a protein antigen. Any appropriate method may be used to generate a conjugate of the invention. For example, suitable methods are detailed below.

Protein-protein linkages in the conjugates of the invention may be generated using any appropriate technique, and the skilled person will be aware of such suitable techniques. Examples of suitable cross-linking agents include protein A, carbodiimide, N-succinimidyl-S-acetyl-thioacetate (SATA), 5,5'-dithiobis(2-nitrobenzoic acid) (DTNB), o-phenylenedimaleimide (oPDM), N-succinimidyl-3-(2-pyridyldithio)propionate (SPDP), and sulfosuccinimidyl 4-(N-maleimidomethyl)cyclohaxane-1-carboxylate (sulfo-SMCC) (see e.g. [122,123]). Other methods include those described in references 124, 125 and 126. Preferred conjugating agents are SATA and sulfo-SMCC, both available from Pierce Chemical Co. (Rockford, Ill.).

Peptide-protein carrier conjugates may also be formed using conventional cross-linking agents such as carbodimides. Examples of carbodimides are 1-cyclohexyl-3-(2-morpholinyl-(4-ethyl) carbodiimide (CMC), 1-ethyl-3-(3-dimethylaminopropyl) carbodiimide (EDC) and 1-ethyl-3-(4-azonia-44-dimethylpentyl) carbodiimide. Examples of other suitable cross-linking agents are cyanogen bromide, glutaraldehyde and succinic anhydride. In general, any of a number of homo-bifunctional agents including a homo-bifunctional aldehyde, a homo-bifunctional epoxide, a homo-bifunctional imido-ester, a homo-bifunctional N-hydroxysuccinimide ester, a homo-bifunctional maleimide, a homo-bifunctional alkyl halide, a homo-bifunctional pyridyl disulfide, a homo-bifunctional aryl halide, a homo-bifunctional hydrazide, a homo-bifunctional diazonium derivative and a homo-bifunctional photoreactive compound may be used. Also included are hetero-bifunctional compounds, for example, compounds having an amine-reactive and a sulfhydryl-reactive group, compounds with an amine-reactive and a photoreactive group and compounds with a carbonyl-reactive and a sulfhydryl-reactive group.

Specific examples of such homo-bifunctional cross-linking agents include the bifunctional N-hydroxysuccinimide esters dithiobis(succinimidylpropionate), disuccinimidyl suberate, and disuccinimidyl tartrate; the bifunctional imido-esters dimethyl adipimidate, dimethyl pimelimidate, and dimethyl suberimidate; the bifunctional sulfhydryl-reactive crosslinkers 1,4-di-[3'-(2'-pyridyldithio)propionamido]butane, bismaleimidohexane, and bis-N-maleimido-1,8-octane; the bifunctional aryl halides 1,5-difluoro-2,4-dinitrobenzene and 4,4'-difluoro-3,3'-dinitrophenylsulfone; bifunctional photoreactive agents such as bis-[β-(4-azidosalicylamido)ethyl]disulfide; the bifunctional aldehydes formaldehyde, malondialdehyde, succinaldehyde, glutaraldehyde, and adipaldehyde; a bifunctional epoxide such as 1,4-butaneodiol diglycidyl ether; the bifunctional hydrazides adipic acid dihydrazide, carbohydrazide, and succinic acid dihydrazide; the bifunctional diazoniums o-tolidine, diazotized and bis-diazotized benzidine; the bifunctional alkylhalides N1,N'-ethylene-bis(iodoacetamide), $N_1$,N'-hexamethylene-bis(iodoacetamide), $N_1$,N'-undecamethylene-bis(iodoacetamide), as well as benzylhalides and halomustards, such as α1,α'-diiodo-p-xylene sulfonic acid and tri(2-chloroethyl)amine, respectively.

Examples of common hetero-bifunctional cross-linking agents that may be used to effect the conjugation of proteins to peptides include, but are not limited to, SMCC (succinimidyl-4-(N-maleimidomethyl)cyclohexane-1-carboxylate), MBS (m-maleimidobenzoyl-N-hydroxysuccinimide ester), SIAB (N-succinimidyl(4-iodoacteyl)aminobenzoate), SMPB (succinimidyl-4-(p-maleimidophenyl)butyrate), GMBS (N-(γ-maleimidobutyryloxy)succinimide ester), MPBH (4-(4-N-maleimidopohenyl)butyric acid hydrazide), M2C2H (4-(N-maleimidomethyl)cyclohexane-1-carboxyl-hydrazide), SMPT (succinimidyloxycarbonyl-α-methyl-α-(2-pyridyldithio)toluene), and SPDP (N-succinimidyl 3-(2-pyridyldithio)propionate). Cross-linking may be accomplished by coupling a carbonyl group to an amine group or to a hydrazide group by reductive amination.

Production and Conjugation of Carrier Molecules Modified to Incorporate Non-Natural Amino Acids Where one or more non-natural amino acid residues are to be incorporated into the carrier molecule, then this can be performed using standard procedures. One such method comprises the use of modified host cells in which the amino acyl tRNA synthetase for a specific codon has been engineered to conjugate the tRNA to a non-natural amino acid which is then incorporated into the carrier during translation [see ref. 127 for a review of such techniques]. Alternatively, some procedures exploit the fact that some non-natural amino acids are incorporated into proteins by the native cellular machinery when the natural cognate amino acid is not present. An example of this second type of procedure is observed in the incorporation of HAG. Where the non-natural amino acid is HAG, then thiyl-ene conjugation is used [see, e.g., ref. 128].

Mixtures Comprising the Conjugates

The conjugates of the invention may be mixed with further antigens. These further antigens may be other conjugates of the invention or they may be other antigens.

For example, mixtures of conjugates are envisaged. Usually, the mixtures of conjugates will be provided as pharmaceutical compositions. At least one of the conjugates in these mixtures is a conjugate of the invention, i.e. the carrier molecule comprises a BP-2a polypeptide and a spb1 polypeptide. The other conjugate(s) in these mixtures may also be conjugates of the invention. However, when the other conjugate(s) are not conjugates of the invention, the carrier molecule may be any suitable carrier protein (as described below).

In preferred embodiments, the conjugates of the invention are mixed with conjugates comprising carrier molecules that do not comprise BP-2a polypeptides and spb1 polypeptides. For example, in particular embodiments, conjugates of the invention are mixed with conjugates comprising $CRM_{197}$ as the carrier molecule. The Examples demonstrate that carrier molecules comprising a BP-2a polypeptide and a spb1 polypeptide can be particularly effective when combined with further conjugates comprising $CRM_{197}$. Similarly, in particular embodiments, conjugates of the invention may be mixed with conjugates comprising GBS80 as a carrier molecule. The Examples demonstrate that carrier molecules comprising a BP-2a polypeptide and a spb1 polypeptide can be particularly effective when combined with further conjugates comprising GBS80. In particularly preferred embodiments, conjugates of the invention are mixed are mixed with conjugates comprising GBS80 and conjugates comprising $CRM_{197}$.

When the conjugates of the invention are mixed with other conjugates, the other conjugates preferably comprise antigens from the same pathogen as the antigen in the conjugate of the invention. For example, mixtures are envisaged comprising a first antigen, such as a saccharide antigen, from a pathogen conjugated to a carrier comprising a BP-2a polypeptide and a spb1 polypeptide, and a second antigen from the same pathogen conjugated to another carrier molecule (and possibly a third antigen from the same pathogen, and a fourth, etc.). The second antigen may be derived from a different serotype. In this way it may be possible to induce broad immune response specific for numerous different antigens, making use of the advantageous properties of the carrier molecule of the invention.

For example, in preferred embodiments, the invention provides a pharmaceutical composition comprising a mixture of conjugates, wherein at least one conjugate comprises a carrier comprising a BP-2a polypeptide and a spb1 polypeptide, and wherein the mixture comprises more than one capsular saccharide derived from *Streptococcus agalactiae* serogroups Ia, Ib, II, III, V. In preferred embodiments, the mixture comprises 4, or all 5 of these saccharides. In particular embodiments, it is the serotype-V saccharide, or even more particularly, the serotype-II saccharide that is conjugated to the BP-2a and spb1 carrier of the invention.

In other embodiments, the invention provides an immunogenic composition comprising: (a) a conjugate that is a capsular saccharide from GBS serotype Ia conjugated to a first carrier protein; (b) a conjugate that is a capsular saccharide from GBS serotype Ib conjugated to a second carrier protein; (c) a conjugate that is a capsular saccharide from GBS serotype III conjugated to a third carrier protein; (d) a conjugate that is a capsular saccharide from GBS serotype II conjugated to a fourth carrier protein; and (e) a conjugate that is a capsular saccharide from GBS serotype V conjugated to a fifth carrier protein, wherein at least one of the first, second, third, fourth or fifth carrier proteins is a BP-2a and spb1 carrier of the invention.

In certain embodiments, the invention provides a pharmaceutical composition comprising *S. agalactiae* saccharides Ia, Ib and III conjugated to CRM197, saccharide from serotype V *S. agalactiae* conjugated to GBS80, and saccharide from serotype II *S. agalactiae* conjugated to the BP-2a and spb1 carrier of the invention. Alternatively, the serotype II saccharide may be conjugated to GBS80, and the serotype V saccharide may be conjugated to the BP-2a and spb1 carrier of the invention.

In a further embodiment, the invention provides a pharmaceutical composition comprising: (a) a conjugate that is a capsular saccharide from GBS serotype Ia conjugated to a first carrier protein, (b) a conjugate that is a capsular saccharide from GBS serotype Ib conjugated to a second carrier protein, (c) a conjugate that is a capsular saccharide from GBS serotype III conjugated to a third carrier protein, wherein the first, second and third carrier proteins are selected from the group consisting of tetanus toxoid (TT), diphtheria toxoid (DT), GBS80, GBS67 and $CRM_{197}$; and, (d) a conjugate that is a capsular saccharide from GBS serotype II conjugated to a fourth carrier protein, and (e) a conjugate that is a capsular saccharide from GBS serotype V conjugated to a fifth carrier protein, wherein one of the fourth or fifth carrier proteins is selected from the group consisting of tetanus toxoid (TT), diphtheria toxoid (DT), GBS67, CRM$_{197}$ and GBS80, and the other of the fourth or fifth carrier proteins comprises a fusion of (i) at least one D3 sub-fragment sequence selected from the group consisting of SEQ ID NO:38, SEQ ID NO:42, SEQ ID NO:40, SEQ ID NO:36, SEQ ID NO:44 and SEQ ID NO:46 and (ii) a D2+D3 fragment of the spb1 polypeptide comprising or consisting of amino acids 185 to 468 of SEQ ID NO:206.

In alternative embodiments, mixtures of conjugates from more than one serogroup of *Neisseria meningitidis* are envisaged e.g. compositions comprising saccharides from serogroups A+C, A+W135, A+Y, C+W135, C+Y, W135+Y, A+C+W135, A+C+Y, C+W135+Y, A+C+W135+Y, etc. Typically, the mixture is a mixture of conjugates comprising saccharides from serogroups A, C, W135 and Y. At least one of the conjugates in these mixtures is a conjugate of the invention, i.e. the carrier molecule comprises a BP-2a polypeptide and a spb1 polypeptide. Typically, the other conjugate(s) in these mixtures will also be conjugates of the invention. However, when the other conjugate(s) are not conjugates of the invention, the carrier molecule may be any suitable carrier protein (as described below), typically the same carrier molecule in each conjugate.

Suitable carrier proteins are bacterial toxins, such as diphtheria or tetanus toxins, or toxoids or mutants thereof. The CRM197 diphtheria toxin mutant [129] may be suitable. Other suitable carrier proteins include the *N. meningitidis* outer membrane protein complex [130], synthetic peptides [131,132], heat shock proteins [133,134], pertussis proteins [135,136], cytokines [137], lymphokines [137], hormones [137], growth factors [137], human serum albumin (typically recombinant), artificial proteins comprising multiple human CD4$^+$ T cell epitopes from various pathogen-derived antigens [20] such as N19 [138], protein D from *Haemophilus influenzae* [139-141], pneumococcal surface protein PspA [142], pneumolysin [143] or its non-toxic derivatives [144], iron-uptake proteins [145], toxin A or B from *Clostridium difficile* [146], a GBS protein [147], a GAS protein [148] etc.

A single carrier protein might carry more than one polysaccharide antigen [149,150]. To achieve this goal, different saccharides can be mixed prior to the conjugation process. Typically, however, there are separate conjugates for each saccharide, with the different saccharides being mixed after conjugation. The separate conjugates may be based on the same carrier, particularly the same carrier comprising a BP-2a polypeptide and a spb1 polypeptide.

The mixtures may also comprise proteins. For example the mixtures may comprise *S. agalactiae* or proteins [e.g. 147, 151-153]

The further antigen(s) may comprise antigens from non-*S. agalactiae* pathogens. Thus the compositions of the invention may further comprise one or more non-*S. agalactiae* antigens, including additional bacterial, viral or parasitic antigens. These may be selected from the following:

a saccharide antigen from *Streptococcus pneumoniae* [e.g. refs. 154-156; chapters 22 & 23 of ref. 163].
an antigen from hepatitis A virus, such as inactivated virus [e.g. 157, 158; chapter 15 of ref. 163].
an antigen from hepatitis B virus, such as the surface and/or core antigens [e.g. 158, 159; chapter 16 of ref. 163].
an antigen from hepatitis C virus [e.g. 160].
an antigen from *Bordetella pertussis*, such as pertussis holotoxin (PT) and filamentous haemagglutinin (FHA) from *B. pertussis*, optionally also in combination with pertactin and/or agglutinogens 2 and 3 [e.g. refs. 161 & 162; chapter 21 of ref. 163].
a diphtheria antigen, such as a diphtheria toxoid [e.g. chapter 13 of ref. 163].
a tetanus antigen, such as a tetanus toxoid [e.g. chapter 27 of ref. 163].
a saccharide antigen from *H. influenzae* B [e.g. chapter 14 of ref. 163].
a protein antigen from serogroup B of *N. meningitidis* [e.g. refs. 164 to 169].
an antigen from *Neisseria gonorrhoeae* [e.g. 164-167].
an antigen from *Chlamydia pneumoniae* [e.g. 170, 171, 172, 173, 174, 175, 176].
an antigen from *Chlamydia trachomatis* [e.g. 177].
an antigen from *Porphyromonas gingivalis* [e.g. 178].
polio antigen(s) [e.g. 179, 180; chapter 24 of ref. 163] such as IPV.
rabies antigen(s) [e.g. 181] such as lyophilised inactivated virus [e.g. 182, RabAvert™].
measles, mumps and/or rubella antigens [e.g. chapters 19, 20 and 26 of ref. 163].
influenza antigen(s) [e.g. chapters 17 & 18 of ref. 163], such as the haemagglutinin and/or neuraminidase surface proteins.
an antigen from *Moraxella catarrhalis* [e.g. 183].
an antigen from *Streptococcus pyogenes* (group A streptococcus) [e.g. 184, 185, 186].
an antigen from *Staphylococcus epidermidis* [e.g. type I, II and/or III capsular polysaccharide obtainable from strains ATCC-31432, SE-360 and SE-10 as described in refs. 187, 188 and 189].

Where a saccharide or carbohydrate antigen is used, it is typically conjugated to a carrier in order to enhance immunogenicity. The carrier molecule may be a carrier of the invention, i.e. a carrier that comprises a BP-2a polypeptide and a spb1 polypeptide. Alternatively, the carrier molecule may be any suitable carrier protein, e.g. as described above. Conjugation of *Haemophilus influenzae* B, meningococcal and pneumococcal saccharide antigens is well known.

Toxic protein antigens may be detoxified where necessary (e.g. detoxification of pertussis toxin by chemical and/or genetic means [162]).

Where a diphtheria antigen is included in the composition it is typical also to include tetanus antigen and pertussis antigens. Similarly, where a tetanus antigen is included it is typical also to include diphtheria and pertussis antigens. Similarly, where a pertussis antigen is included it is typical also to include diphtheria and tetanus antigens.

Antigens may be adsorbed to an aluminium salt. Antigens in the composition will typically be present at a concentration of at least 1 µg/ml each. In general, the concentration of any given antigen will be sufficient to elicit an immune response against that antigen.

As an alternative to using proteins antigens in the composition of the invention, nucleic acid encoding the antigen may be used [e.g. refs. 190 to 198]. Protein components of the compositions of the invention may thus be replaced by nucleic acid (usually DNA e.g. in the form of a plasmid) that encodes the protein.

In practical terms, there may be an upper limit to the number of antigens included in compositions of the invention. The number of antigens (including conjugates of the invention) in a composition of the invention may be less than 20, less than 19, less than 18, less than 17, less than 16, less than 15, less than 14, less than 13, less than 12, less than 11, less than 10, less than 9, less than 8, less than 7, less than 6, less than 5, less than 4, or less than 3. The number of conjugates of the invention in a composition may be less than 6, less than 5, or less than 4.

Pharmaceutical Compositions Comprising the Conjugates

The invention provides a pharmaceutical composition comprising (a) a conjugate of the invention, and (b) a pharmaceutically acceptable carrier. A thorough discussion of such carriers is available in reference 199.

Microbial infections affect various areas of the body and so the compositions of the invention may be prepared in various forms. For example, the compositions may be prepared as injectables, either as liquid solutions or suspensions. Solid forms suitable for solution in, or suspension in, liquid vehicles prior to injection can also be prepared. The composition may be prepared for topical administration e.g. as an ointment, cream or powder. The composition be prepared for oral administration e.g. as a tablet or capsule, or as a syrup (optionally flavoured). The composition may be prepared for pulmonary administration e.g. as an inhaler, using a fine powder or a spray. The composition may be prepared as a suppository or pessary. The composition may be prepared for nasal, aural or ocular administration e.g. as drops, as a spray, or as a powder [e.g. 200]. The composition may be included in a mouthwash. The composition may be lyophilised.

The pharmaceutical composition is preferably sterile. It is preferably pyrogen-free. It is preferably buffered e.g. at between pH 6 and pH 8, generally around pH 7.

The invention also provides a delivery device containing a pharmaceutical composition of the invention. The device may be, for example, a syringe or an inhaler.

Pharmaceutical compositions of the invention are preferably immunogenic compositions, in that they comprise an immunologically effective amount of an antigen. By 'immunologically effective amount', it is meant that the administration of that amount to an individual, either in a single dose or as part of a series, is effective for treatment or prevention. This amount varies depending upon the health and physical condition of the individual to be treated, age, the taxonomic group of individual to be treated (e.g. non-human primate, primate, etc.), the capacity of the individual's immune system to synthesise antibodies, the degree of protection desired, the formulation of the vaccine, the treating doctor's assessment of the medical situation, and other relevant factors. It is expected that the amount will fall in a relatively broad range that can be determined through routine trials. Dosage treatment may be a single dose schedule or a multiple dose schedule (e.g. including booster doses). The composition may be administered in conjunction with other immunoregulatory agents.

Once formulated, the compositions of the invention can be administered directly to the subject. The subjects to be treated can be animals; in particular, human subjects can be treated.

Immunogenic compositions of the invention may be used therapeutically (i.e. to treat an existing infection) or prophylactically (i.e. to prevent future infection).

An immunogenic composition may include a further adjuvant, which can function to enhance the immune responses (humoral and/or cellular) elicited in a patient who receives the composition. Adjuvants that can be used with the invention include, but are not limited to:

A mineral-containing composition, including calcium salts and aluminum salts (or mixtures thereof). Calcium salts include calcium phosphate (e.g. the "CAP" particles disclosed in ref. 201). Aluminum salts include hydroxides, phosphates, sulfates, etc., with the salts taking any suitable form (e.g. gel, crystalline, amorphous, etc.). Adsorption to these salts is preferred. The mineral containing compositions may also be formulated as a particle of metal salt [202]. The adjuvants known as aluminum hydroxide and aluminum phosphate may be used. These names are conventional, but are used for convenience only, as neither is a precise description of the actual chemical compound which is present (e.g. see chapter 9 of reference 285). The invention can use any of the "hydroxide" or "phosphate" adjuvants that are in general use as adjuvants. The adjuvants known as "aluminium hydroxide" are typically aluminium oxyhydroxide salts, which are usually at least partially crystalline. The adjuvants known as "aluminium phosphate" are typically aluminium hydroxyphosphates, often also containing a small amount of sulfate (i.e. aluminium hydroxyphosphate sulfate). They may be obtained by precipitation, and the reaction conditions and concentrations during precipitation influence the degree of substitution of phosphate for hydroxyl in the salt. The invention can use a mixture of both an aluminium hydroxide and an aluminium phosphate. In this case there may be more aluminium phosphate than hydroxide e.g. a weight ratio of at least 2:1 e.g. ≥5:1, ≥6:1, ≥7:1, ≥8:1, ≥9:1, etc. The concentration of $Al^{+++}$ in a composition for administration to a patient is preferably less than 10 mg/ml e.g. ≤5 mg/ml, ≤4 mg/ml, ≤3 mg/ml, ≤2 mg/ml, ≤1 mg/ml, etc. A preferred range is between 0.3 and 1 mg/ml. A maximum of 0.85 mg/dose is preferred.

Saponins [chapter 22 of ref. 285], which are a heterologous group of sterol glycosides and triterpenoid glycosides that are found in the bark, leaves, stems, roots and even flowers of a wide range of plant species. Saponin from the bark of the *Quillaia saponaria* Molina tree have been widely studied as adjuvants. Saponin can also be commercially obtained from *Smilax ornata* (sarsaprilla), *Gypsophilla paniculata* (brides veil), and *Saponaria officianalis* (soap root). Saponin adjuvant formulations include purified formulations, such as QS21, as well as lipid formulations, such as ISCOMs. QS21 is marketed as Stimulon™. Saponin compositions have been purified using HPLC and RP-HPLC. Specific purified fractions using these techniques have been identified, including QS7, QS17, QS18, QS21, QH-A, QH-B and QH-C. Preferably, the saponin is QS21. A method of production of QS21 is disclosed in ref. 203. Saponin formulations may also comprise a sterol, such as cholesterol [204]. Combinations of saponins and cholesterols can be used to form unique particles called immunostimulating complexes (ISCOMs) [chapter 23 of ref. 285]. ISCOMs typically also include a phospholipid such as phosphatidylethanolamine or phosphatidylcholine. Any known saponin can be used in ISCOMs. Preferably, the ISCOM includes one or more of QuilA, QHA & QHC. ISCOMs are further described in refs. 204-206. Optionally, the ISCOMS may be devoid of additional detergent [207]. A review of the development of saponin based adjuvants can be found in refs. 208 & 209.

Bacterial ADP-ribosylating toxins (e.g. the *Escherichia coli* heat labile enterotoxin "LT", cholera toxin "CT", or pertussis toxin "PT") and detoxified derivatives thereof, such as the mutant toxins known as LT-K63 and LT-R72 [210]. The use of detoxified ADP-ribosylating toxins as mucosal adjuvants is described in ref. 211 and as parenteral adjuvants in ref. 212.

Bioadhesives and mucoadhesives, such as esterified hyaluronic acid microspheres [213] or chitosan and its derivatives [214].

Microparticles (i.e. a particle of ~100 nm to ~150 μm in diameter, more preferably ~200 nm to ~30 μm in diameter, or ~500 nm to ~10 μm in diameter) formed from materials that are biodegradable and non-toxic (e.g. a poly(α-hydroxy acid), a polyhydroxybutyric acid, a polyorthoester, a polyanhydride, a polycaprolactone, etc.), with poly(lactide-co-glycolide) being preferred, optionally treated to have a negatively-charged surface (e.g. with SDS) or a positively-charged surface (e.g. with a cationic detergent, such as CTAB).

Liposomes (Chapters 13 & 14 of ref. 285). Examples of liposome formulations suitable for use as adjuvants are described in refs. 215-217.

Muramyl peptides, such as N-acetylmuramyl-L-threonyl-D-isoglutamine ("thr-MDP"), N-acetyl-normuramyl-L-alanyl-D-isoglutamine (nor-MDP), N-acetylglucsaminyl-N-acetylmuramyl-L-Al-D-isoglu-L-Ala-dipalmitoxy propylamide ("DTP-DPP", or "Theramide™"), N-acetylmuramyl-L-alanyl-D-isoglutaminyl-L -alanine-2-(1'-2'dipalmitoyl-sn-glycero-3-hydroxy-phosphoryloxy)-ethylamine ("MTP-PE").

A polyoxidonium polymer [218,219] or other N-oxidized polyethylene-piperazine derivative.

Methyl inosine 5'-monophosphate ("MIMP") [220].

A polyhydroxlated pyrrolizidine compound [221], such as one having formula:

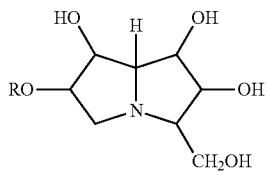

where R is selected from the group comprising hydrogen, straight or branched, unsubstituted or substituted, saturated or unsaturated acyl, alkyl (e.g. cycloalkyl), alkenyl, alkynyl and aryl groups, or a pharmaceutically acceptable salt or derivative thereof. Examples include, but are not limited to: casuarine, casuarine-6-α-D-glucopyranose, 3-epi-casuarine, 7-epi-casuarine, 3,7-diepi-casuarine, etc.

A CD1d ligand, such as an α-glycosylceramide [222-229] (e.g. α-galactosylceramide), phytosphingosine-containing α-glycosylceramides, OCH, KRN7000 [(2S,3S,4R)-1-O-(α-D-galactopyranosyl)-2-(N-hexacosanoylamino)-1,3,4-octadecanetriol], CRONY-101, 3"-O-sulfo-galactosylceramide, etc.

A gamma inulin [230] or derivative thereof, such as algammulin.

An oil-in-water emulsion. Various such emulsions are known, and they typically include at least one oil and at least one surfactant, with the oil(s) and surfactant(s) being biodegradable (metabolisable) and biocompatible. The oil droplets in the emulsion are generally less than 5 μm in diameter, and may even have a sub-micron diameter, with these small sizes being achieved with a microfluidiser to provide stable emulsions. Droplets with a size less than 220 nm are preferred as they can be subjected to filter sterilization.

An immunostimulatory oligonucleotide, such as one containing a CpG motif (a dinucleotide sequence containing an unmethylated cytosine residue linked by a phosphate bond to a guanosine residue), or a CpI motif (a dinucleotide sequence containing cytosine linked to inosine), or a double-stranded RNA, or an oligonucleotide containing a palindromic sequence, or an oligonucleotide containing a poly(dG) sequence. Immunostimulatory oligonucleotides can include nucleotide modifications/analogs such as phosphorothioate modifications and can be double-stranded or (except for RNA) single-stranded. References 231, 232 and 233 disclose possible analog substitutions e.g. replacement of guanosine with 2'-deoxy-7-deazaguanosine. The adjuvant effect of CpG oligonucleotides is further discussed in refs. 234-239. A CpG sequence may be directed to TLR9, such as the motif GTCGTT or TTCGTT [240]. The CpG sequence may be specific for inducing a Th1 immune response, such as a CpG-A ODN (oligodeoxynucleotide), or it may be more specific for inducing a B cell response, such a CpG-B ODN. CpG-A and CpG-B ODNs are discussed in refs. 241-243. Preferably, the CpG is a CpG-A ODN. Preferably, the CpG oligonucleotide is constructed so that the 5' end is accessible for receptor recognition. Optionally, two CpG oligonucleotide sequences may be attached at their 3' ends to form "immunomers". See, for example, references 240 & 244-246. A useful CpG adjuvant is CpG7909, also known as ProMune™ (Coley Pharmaceutical Group, Inc.). Another is CpG1826. As an alternative, or in addition, to using CpG sequences, TpG sequences can be used [247], and these oligonucleotides may be free from unmethylated CpG motifs. The immunostimulatory oligonucleotide may be pyrimidine-rich. For example, it may comprise more than one consecutive thymidine nucleotide (e.g. TT-TT, as disclosed in ref. 247), and/or it may have a nucleotide composition with >25% thymidine (e.g. >35%, >40%, >50%, >60%, >80%, etc.). For example, it may comprise more than one consecutive cytosine nucleotide (e.g. CCCC, as disclosed in ref. 247), and/or it may have a nucleotide composition with >25% cytosine (e.g. >35%, >40%, >50%, >60 %, >80%, etc.). These oligonucleotides may be free from unmethylated CpG motifs. Immunostimulatory oligonucleotides will typically comprise at least 20 nucleotides. They may comprise fewer than 100 nucleotides.

A particularly useful adjuvant based around immunostimulatory oligonucleotides is known as IC31™ [248]. Thus an adjuvant used with the invention may comprise a mixture of (i) an oligonucleotide (e.g. between 15-40 nucleotides) including at least one (and preferably multiple) CpI motifs, and (ii) a polycationic polymer, such as an oligopeptide (e.g. between 5-20 amino acids) including at least one (and preferably multiple) Lys-Arg-Lys tripeptide sequence(s). The oligonucleotide may be a deoxynucleotide comprising 26-mer sequence 5'-(IC)$_{13}$-3' (SEQ ID NO:98). The polycationic polymer may be a peptide comprising 11-mer amino acid sequence KLKLLLLLKLK (SEQ ID NO:99).

3-O-deacylated monophosphoryl lipid A ('3 dMPL', also known as 'MPL™') [249-252]. In aqueous conditions, 3 dMPL can form micellar aggregates or particles with different sizes e.g. with a diameter <150 nm or >500 nm. Either or both of these can be used with the invention, and the better particles can be selected by routine assay. Smaller particles (e.g. small enough to give a clear aqueous suspension of 3 dMPL) are preferred for use according to the invention because of their superior activity [253]. Preferred particles have a mean diameter less than 220 nm, more preferably less than 200 nm or less than 150 nm or less than 120 nm, and can even have a mean diameter less than 100 nm. In most cases, however, the mean diameter will not be lower than 50 nm.

An imidazoquinoline compound, such as Imiquimod ("R-837") [254,255], Resiquimod ("R-848") [256], and their analogs; and salts thereof (e.g. the hydrochloride salts). Further details about immunostimulatory imidazoquinolines can be found in references 257 to 261.

A thiosemicarbazone compound, such as those disclosed in reference 262. Methods of formulating, manufacturing, and screening for active compounds are also described in reference 262. The thiosemicarbazones are particularly effective in the stimulation of human peripheral blood mononuclear cells for the production of cytokines, such as TNF-α.

A tryptanthrin compound, such as those disclosed in reference 263. Methods of formulating, manufacturing, and screening for active compounds are also described in reference 263. The thiosemicarbazones are particularly effective in the stimulation of human peripheral blood mononuclear cells for the production of cytokines, such as TNF-α.

A nucleoside analog, such as: (a) Isatorabine (ANA-245; 7-thia-8-oxoguanosine):

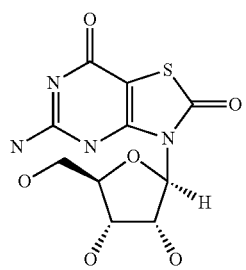 [SMILES: Nc1nc(=O)c2sc(=O)n([C@@H]3O[C@H](CO)[C@@H](O)[C@H]3O)c2[nH]1]

and prodrugs thereof; (b) ANA975; (c) ANA-025-1; (d) ANA380; (e) the compounds disclosed in references 264 to 266 and Loxoribine (7-allyl-8-oxoguanosine) [267].

Compounds disclosed in reference 268, including: Acylpiperazine compounds, Indoledione compounds, Tetrahydraisoquinoline (THIQ) compounds, Benzocyclodione compounds, Aminoazavinyl compounds, Aminobenzimidazole quinolinone (ABIQ) compounds [269,270], Hydrapthalamide compounds, Benzophenone compounds, Isoxazole compounds, Sterol compounds, Quinazilinone compounds, Pyrrole compounds [271], Anthraquinone compounds, Quinoxaline compounds, Triazine compounds, Pyrazalopyrimidine compounds, and Benzazole compounds [272].

An aminoalkyl glucosaminide phosphate derivative, such as RC-529 [273,274].

A phosphazene, such as poly[di(carboxylatophenoxy) phosphazene] ("PCPP") as described, for example, in references 275 and 276.

A substituted urea or compound of formula I, II or III, or a salt thereof:

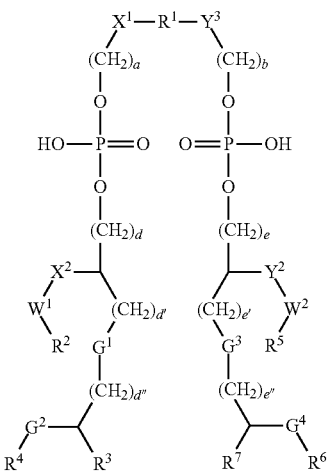

I

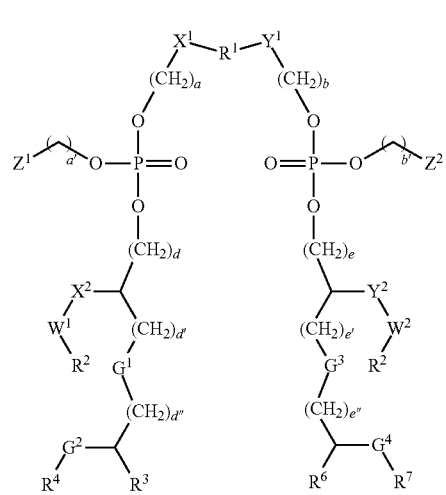

II

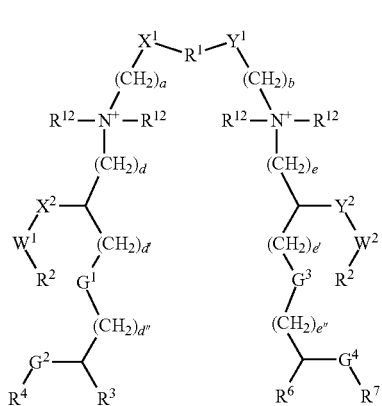

III as defined in reference 277, such as 'ER 803058', 'ER 803732', 'ER 804053', ER 804058', 'ER 804059', 'ER 804442', 'ER 804680', 'ER 804764', ER 803022 or 'ER 804057' e.g.:

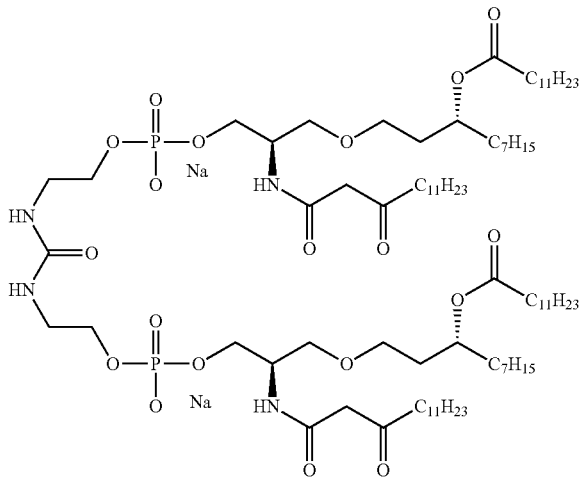

ER804057

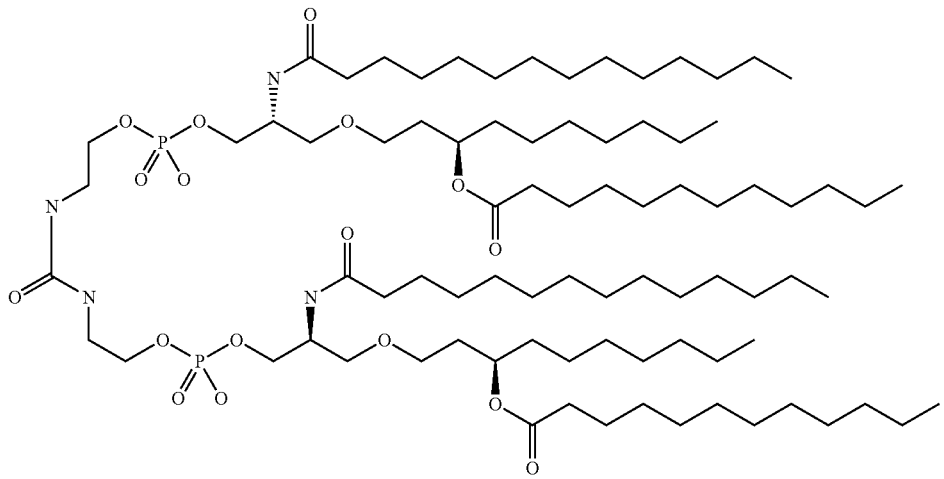

ER-803022

Derivatives of lipid A from *Escherichia coli* such as OM-174 (described in refs. 278 & 279).

Compounds containing lipids linked to a phosphate-containing acyclic backbone, such as the TLR4 antagonist E5564 [280,281]:

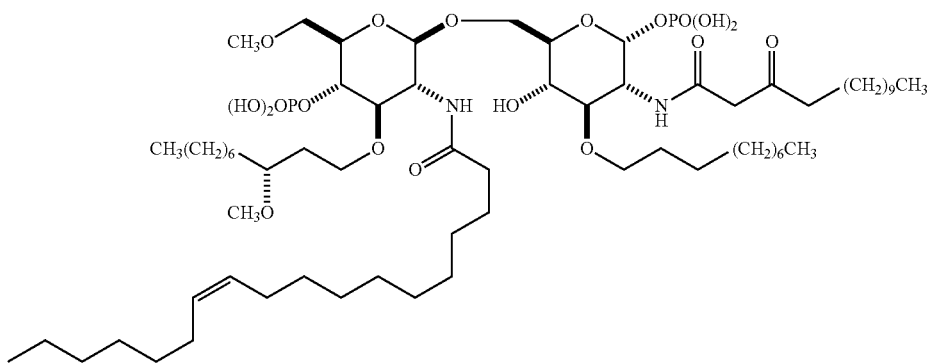

These and other adjuvant-active substances are discussed in more detail in references 285 & 286.

Antigens and adjuvants in a composition will typically be in admixture.

Compositions may include two or more of said adjuvants. For example, they may advantageously include both an oil-in-water emulsion and 3 dMPL, etc.

Specific oil-in-water emulsion adjuvants useful with the invention include, but are not limited to:

A submicron emulsion of squalene, Tween 80, and Span 85. The composition of the emulsion by volume can be about 5% squalene, about 0.5% polysorbate 80 and about 0.5% Span 85. In weight terms, these ratios become 4.3% squalene, 0.5% polysorbate 80 and 0.48% Span 85. This adjuvant is known as 'MF59®' [282-284], as described in more detail in Chapter 10 of ref. 285 and chapter 12 of ref. 286. The MF59® emulsion advantageously includes citrate ions e.g. 10 mM sodium citrate buffer.

An emulsion of squalene, a tocopherol, and Tween 80. The emulsion may include phosphate buffered saline. It may also include Span 85 (e.g. at 1%) and/or lecithin. These emulsions may have from 2 to 10% squalene, from 2 to 10% tocopherol and from 0.3 to 3% Tween 80, and the weight ratio of squalene:tocopherol is preferably ≤1 as this provides a more stable emulsion. Squalene and Tween 80 may be present volume ratio of about 5:2. One such emulsion can be made by dissolving Tween 80 in PBS to give a 2% solution, then mixing 90 ml of this solution with a mixture of (5 g of DL-α-tocopherol and 5 ml squalene), then microfluidising the mixture. The resulting emulsion may have submicron oil droplets e.g. with an average diameter of between 100 and 250 nm, preferably about 180 nm.

An emulsion of squalene, a tocopherol, and a Triton detergent (e.g. Triton X-100). The emulsion may also include a 3d-MPL (see below). The emulsion may contain a phosphate buffer.

An emulsion comprising a polysorbate (e.g. polysorbate 80), a Triton detergent (e.g. Triton X-100) and a tocopherol (e.g. an a-tocopherol succinate). The emulsion may include these three components at a mass ratio of about 75:11:10 (e.g. 750 μg/ml polysorbate 80, 110 μg/ml Triton X-100 and 100 μg/ml a-tocopherol succinate), and these concentrations should include any contribution of these components from antigens. The emulsion may also include squalene. The emulsion may also include a 3d-MPL (see below). The aqueous phase may contain a phosphate buffer.

An emulsion of squalane, polysorbate 80 and poloxamer 401 ("Pluronic™ L121"). The emulsion can be formulated in phosphate buffered saline, pH 7.4. This emulsion is a useful delivery vehicle for muramyl dipeptides, and has been used with threonyl-MDP in the "SAF-1" adjuvant [287] (0.05-1% Thr-MDP, 5% squalane, 2.5% Pluronic L121 and 0.2% polysorbate 80). It can also be used without the Thr-MDP, as in the "AF" adjuvant [288] (5% squalane, 1.25% Pluronic L121 and 0.2% polysorbate 80). Microfluidisation is preferred.

An emulsion having from 0.5-50% of an oil, 0.1-10% of a phospholipid, and 0.05-5% of a non-ionic surfactant. As described in reference 289, preferred phospholipid components are phosphatidylcholine, phosphatidylethanolamine, phosphatidylserine, phosphatidylinositol, phosphatidylglycerol, phosphatidic acid, sphingomyelin and cardiolipin. Submicron droplet sizes are advantageous.

A submicron oil-in-water emulsion of a non-metabolisable oil (such as light mineral oil) and at least one surfactant (such as lecithin, Tween 80 or Span 80). Additives may be included, such as QuilA saponin, cholesterol, a saponin-lipophile conjugate (such as GPI-0100, described in reference 290, produced by addition of aliphatic amine to desacylsaponin via the carboxyl group of glucuronic acid), dimethyidioctadecylammonium bromide and/or N,N-dioctadecyl-N, N-bis (2-hydroxyethyl)propanediamine.

An emulsion in which a saponin (e.g. QuilA or QS21) and a sterol (e.g. a cholesterol) are associated as helical micelles [291].

Particular adjuvants for use with immunogenic compositions of the invention include MF59®, Alum and/or toll-like receptor 7 (TLR7) agonists, for example, as disclosed in EP2459216 herein incorporated by reference.

Medical Treatments and Uses

The invention also provides a conjugate of the invention, for use in medicine e.g. for use in raising an antibody response in a suitable mammal. The invention also provides a method for raising an immune response in a suitable mammal, comprising administering a conjugate or pharmaceutical composition of the invention to the mammal. The invention also provides the use of a conjugate of the invention in the manufacture of a medicament for preventing or treating a microbial infection in a suitable mammal.

The immune response raised by these methods and uses will generally include an antibody response, preferably a protective antibody response. Methods for assessing antibody responses after antigen immunisation are well known in the art. The antibody response is preferably an IgA or IgG response. The immune response may be prophylactic and/or therapeutic. The mammal is preferably a human, particularly a human female, more particularly a pregnant human female.

Efficacy of therapeutic treatment can be tested by monitoring microbial infection after administration of the composition of the invention. Efficacy of prophylactic treatment can be tested by monitoring immune responses against antigen (e.g. anti-antigen antibodies) after administration of the composition.

Compositions of the invention will generally be administered directly to a patient. Direct delivery may be accomplished by parenteral injection (e.g. subcutaneously, intraperitoneally, intravenously, intramuscularly, or to the interstitial space of a tissue), or by rectal, oral, vaginal, topical, transdermal, intradermal, ocular, nasal, aural, or pulmonary administration. Injection or intranasal administration is preferred. The invention may be used to elicit systemic and/or mucosal immunity.

Vaccines prepared according to the invention may be used to treat both children and adults. Thus a subject may be less than 1 year old, 1-5 years old, 5-15 years old, 15-55 years old, or at least 55 years old. Particular subjects for receiving the vaccines are the elderly (e.g. ≥50 years old, ≥55 years old, ≥60 years old, and ≥65 years), or the young (e.g. ≤5 years old). The vaccines are not suitable solely for these groups, however, and may be used more generally in a population.

Treatment can be by a single dose schedule or a multiple dose schedule. Multiple doses may be used in a primary immunisation schedule and/or in a booster immunisation schedule. In a multiple dose schedule the various doses may be given by the same or different routes e.g. a parenteral prime and mucosal boost, a mucosal prime and parenteral boost, etc. Administration of more than one dose (typically two doses) is particularly useful in immunologically naïve patients. Multiple doses will typically be administered at least 1 week apart (e.g. about 2 weeks, about 3 weeks, about 4 weeks, about 6 weeks, about 8 weeks, about 10 weeks, about 12 weeks, about 16 weeks, etc.).

The uses and methods of the invention are particularly useful for treating/protecting against infections caused by the organism from which the antigen is derived. Exemplary uses/methods are discussed below.

*Streptococcus agalactiae* Capsular Saccharides

The uses and methods may be for the prevention and/or treatment of a disease caused by *Streptococcus agalactiae*. The examples demonstrate that the carrier molecules of the invention are particularly effective carriers for *S. agalactiae* saccharides. In addition, the BP-2a and spb1 polypeptides of the carrier may also be able to help induce a carrier-specific immune response that is protective. Immunogenic compositions comprising carrier proteins of the invention may be for use in: (i) a method for treating or preventing an infectious disease caused by *Streptococcus agalactiae*; or (ii) a method for inducing an immune response against *Streptococcus agalactiae* in a subject; or (iii) a method of vaccinating a subject to protect against or reduce the symptoms of infection by *Streptococcus agalactiae*, wherein the method comprises administering to a subject in need thereof a therapeutically effective amount of said composition. In particular embodiments immunogenic compositions comprising carrier proteins of the invention may be for use in a method of providing protective immunity against *Streptococcus agalactiae* or protecting from a disease caused by *Streptococcus agalactiae* in an infant, wherein the infant was born to a female to whom a therapeutically effective amount of the composition was administered during the time when said female was pregnant with said infant. The disease caused by *Streptococcus agalactiae* may be Early Onset Disease (EOD) and/or Late Onset Disease (LOD).

*Neisseria meningitidis* Capsular Saccharides

The uses and methods may be for the prevention and/or treatment of a disease caused by *Neisseria meningitidis*, e.g. meningitis, septicaemia, etc.

Glucans

Because glucans (and β-glucans in particular) are an essential and principal polysaccharide constituent of almost all pathogenic fungi, particularly those involved in infections in immunocompromised subjects, and also in bacterial pathogens and protozoa, anti-glucan immunity may have efficacy against a broad range of pathogens and diseases. For example, anti-glucan serum raised after immunisation with *Saccharomyces cerevisiae* is cross-reactive with *Candida albicans*. Broad spectrum immunity is particularly useful because, for these human infectious fungal agents, chemotherapy is scanty, antifungal drug resistance is emerging and the need for preventative and therapeutic vaccines is increasingly recognized.

The uses and methods of the invention are particularly useful for treating/protecting against infections of: *Candida* species, such as *C. albicans*; *Cryptococcus* species, such as *C. neoformans*; *Enterococcus* species, such as *E. faecalis*; *Streptococcus* species, such as *S. pneumoniae*, *S. mutans*, *S. agalactiae* and *S. pyogenes*; *Leishmania* species, such as *L. major*; *Acanthamoeba* species, such as *A. castellani*; *Aspergillus* species, such as *A. fumigatus* and *A. flavus*; *Pneumocystis* species, such as *P. carinii*; *Mycobacterium* species, such as *M. tuberculosis*; *Pseudomonas* species, such as *P. aeruginosa*; *Staphylococcus* species, such as *S. aureus*; *Salmonella* species, such as *S. typhimurium*; *Coccidioides* species such as *C. immitis*; *Trichophyton* species such as *T. verrucosum*; *Blastomyces* species such as *B. dermatidis*; *Histoplasma* species such as *H. capsulatum*; *Paracoccidioides* species such as *P. brasiliensis*; *Pythium* species such as *P. insidiosum*; and *Escherichia* species, such as *E. coli*.

The uses and methods are particularly useful for preventing/treating diseases including, but not limited to: candidiasis (including hepatosplenic candidiasis, invasive candidiasis, chronic mucocutaneous candidiasis and disseminated candidiasis); candidemia; aspergillosis, cryptococcosis, dermatomycoses, sporothrychosis and other subcutaneous mycoses, blastomycosis, histoplasmosis, coccidiomycosis, paracoccidiomycosis, pneumocystosis, thrush, tuberculosis, mycobacteriosis, respiratory infections, scarlet fever, pneumonia, impetigo, rheumatic fever, sepsis, septicaemia, cutaneous and visceral leishmaniasis, corneal acanthamoebiasis, cystic fibrosis, typhoid fever, gastroenteritis and hemolyticuremic syndrome. Anti-*C. albicans* activity is particularly useful for treating infections in AIDS patients.

Conjugates of the invention may be combined with non-glucan antigens into a single composition for simultaneous immunisation against multiple pathogens. As an alternative to making a combined vaccine, conjugates may be administered to patients at substantially the same time as (e.g. during the same medical consultation or visit to a healthcare professional or vaccination centre) other vaccines. Antigens for use in these combination vaccines or for concomitant administration include, for instance, immunogens from *Streptococcus agalactiae*, *Staphylococcus aureus* and/or *Pseudomonas aeuruginosa*, hepatitis A virus, hepatitis B virus, *Neisseria meningitidis* (such as saccharides or conjugated saccharides, for serogroups A, C, W135 and/or Y), *Streptococcus pneumoniae* (such as saccharides or conjugated saccharides), etc.

Conjugates of the invention may be used in conjunction with anti-fungals, particularly where a patient is already infected. The anti-fungal offers an immediate therapeutic effect whereas the conjugate offers a longer-lasting effect. Suitable anti-fungals include, but are not limited to, azoles (e.g. fluconazole, itraconazole), polyenes (e.g. amphotericin B), flucytosine, and squalene epoxidase inhibitors (e.g. terbinafine) [see also ref. 292]. The anti-fungal and the conjugate may be administered separately or in combination. When administered separately, they will typically be administered within 7 days of each other. After the first administration of an conjugate, the anti-fungal may be administered more than once.

*Streptococcus pyogenes* Capsular Saccharides

The uses and methods may be for the prevention and/or treatment of a disease caused by Group A *streptococcus*.

*Streptococcus pneumoniae* Capsular Saccharides

The uses and methods may be for the prevention and/or treatment of a disease caused by pneumococcus, e.g. meningitis, sepsis, pneumonia etc.

Definitions

The practice of the present invention will employ, unless otherwise indicated, conventional methods of chemistry, biochemistry, molecular biology, immunology and pharmacology, within the skill of the art. Such techniques are explained fully in the literature. See, e.g., references 199 and 293-299, etc.

"GI" numbering is used above. A GI number, or "GenInfo Identifier", is a series of digits assigned consecutively to each sequence record processed by NCBI when sequences are added to its databases. The GI number bears no resemblance to the accession number of the sequence record. When a sequence is updated (e.g. for correction, or to add more annotation or information) then it receives a new GI number. Thus the sequence associated with a given GI number is never changed.

Where an antigen "domain" is omitted, this may involve omission of a signal peptide, of a cytoplasmic domain, of a transmembrane domain, of an extracellular domain, etc.

The term "comprising" encompasses "including" as well as "consisting" e.g. a composition "comprising" X may consist exclusively of X or may include something additional e.g. X+Y. The term "consisting essentially of" means that the composition, method or structure may include additional ingredients, steps and/or parts, but only if the additional ingredients, steps and/or parts do not materially alter the basic and novel characteristics of the claimed composition, method or structure. The term "consisting of" is generally taken to mean that the invention as claimed is limited to those elements specifically recited in the claim (and may include their equivalents, insofar as the doctrine of equivalents is applicable).

The term "about" in relation to a numerical value x means, for example, +two standard deviations of the value. In certain embodiments, "about" is understood as acceptable variation and tolerances within the specific art. For example, when referring to a measurable value such as an amount, a temporal duration, and the like, may encompass variations of ±20% or ±10%, more preferably ±5%, even more preferably ±1%, and still more preferably ±0.1% from the specified value, as such variations are appropriate to perform the disclosed methods.

The word "substantially" does not exclude "completely" e.g. a composition which is "substantially free" from Y may be completely free from Y. For example, "substantially free" from Y can be understood as a composition containing not more than 5% Y, not more than 4% Y, not more than 3% Y, not more than 2% Y, not more than 1% Y, or not more than 0.1% Y. Where necessary, the word "substantially" may be omitted from the definition of the invention.

The term "canonical" in relation to amino acids means that the amino acid is one of the twenty amino acids encoded by the universal genetic code, i.e. Alanine, Asparagine, Aspartic acid, Arginine, Cysteine, Glutamine, Glycine, Glutamic acid, Histidine, Isoleucine, Lysine, Leucine, Phenylalanine, Methionine, Serine, Proline, Tryptophan, Threonine, Tyrosine and Valine.

As used herein, "a" and "the" are understood to include both singular and plural unless otherwise clearly indicated by context.

As used herein the term "fragment" refers to a sequence that is a subset of another sequence. When used in the context of a nucleic acid or amino acid sequence the terms "fragment" and "subsequence" are used interchangeably. These terms are used to refer to a part or portion of an intact or complete wild-type polypeptide but which comprise fewer amino acid residues than an intact or complete wild-type polypeptide. Thus, the term refers to truncated or shorter amino acid sequences corresponding to one or more regions of a wild-type or reference polypeptide. It will be clear to those skilled in the art that, whilst such fragments are truncated or shorter fragments of a reference sequence, such fragments may be modified to comprise additional sequences not found in the reference polypeptide, for example, to form fusion polypeptides, include 'tag' sequences such as His tags or Glutathione S-transferase (GST) tags, linker sequences and the like. Thus, in such modified fragments the amino group of the N terminal amino acid of the fragment is not linked by a peptide bond to the carboxyl group of an amino acid to which it is linked in the reference polypeptide and/or the carboxyl group of the C terminal amino acid of the fragment is not linked by a peptide bond to the amino group of an amino acid to which it is linked in the reference polypeptide. The percent identity of a first polypeptide and a second polypeptide is generally determined by counting the number of matched positions between the first and second polypeptides and dividing that number by the total length of the shortest polypeptide followed by multiplying the resulting value by 100. For fragments of polypeptides this value is usually determined to be around 100% and therefore has little meaning. Therefore, in the context of fragments of the present invention, the term "proportion of reference polypeptide" (expressed as a percentage) may used. Proportion of reference polypeptide is calculated by counting the number of matched positions between the fragment and reference polypeptides and dividing that number by the total length of the reference polypeptide followed by multiplying the resulting value by 100. Particularly, fragments will comprise less than 90, 80, 70, 65, 60, 55, 50, 45, 40, 35, 30, 25 or less than 20% of the sequence of the reference polypeptide.

Unless specifically stated, a process comprising a step of mixing two or more components does not require any specific order of mixing. Thus components can be mixed in any order. Where there are three components then two components can be combined with each other, and then the combination may be combined with the third component, etc.

Where animal (and particularly bovine) materials are used in the culture of cells, they should be obtained from sources that are free from transmissible spongiform encaphalopathies (TSEs), and in particular free from bovine spongiform encephalopathy (BSE). Overall, it is preferred to culture cells in the total absence of animal-derived materials.

Where a compound is administered to the body as part of a composition then that compound may alternatively be replaced by a suitable prodrug.

References to a percentage sequence identity between two amino acid sequences means that, when aligned, that percentage of amino acids are the same in comparing the two sequences. Generally, percentage sequence identity is calculated by dividing the number of identical amino acids by the total number of amino acids in the longer sequence. This alignment and the percent homology or sequence identity can be determined using software programs known in the art, for example those described in section 7.7.18 of ref. 300. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref. 301.

All GenBank Accession numbers provided herein are incorporated by reference in the version available on the date of filing the instant application.

EXAMPLES

Example 1: GBS59(6XD3)-GBS1523 Fusion

The fusion protein "GBS59(6XD3)-GSG4-1523" gene (SEQ ID:276) was generated by PIPE cloning by amplifying the gene of 59(6XD3) (again from a synthetic gene purchased from geneart) using the primers 59pipeF (SEQ ID NO:278), 59GSG41523.R (SEQ ID NO:281) and, the gbs1523 gene from genomic GBS COH1 strain DNA using the primers 59GSG41523.F (SEQ ID NO:280) and 1523pipe.R (SEQ ID NO:279). The two I-PCR, containing an overlapping region of 18 bp (SEQ ID NO:282) corresponding to the GSG4 linker (SEQ ID NO:272), were co-used in a PIPE reaction using the pET15 TEV Vector-PCR (coding for N-terminal 6XHIS-TEV tag ("6XHIS" disclosed as SEQ ID NOs: 79 and 275)) and co-transformed in the HK100 E. coli Strain. The correct sequence was verified by DNA sequencing of the obtained clones.

In order to generate the tagless 59(6XD3)-GSG4-1523 fusion protein, the 59(6XD3)-GSG4-1523 gene was further amplified from the pET15-TEV-59(6XD3)-GSG4-1523 clone ("GSG4" disclosed as SEQ ID NO: 272) by using the primers 596xD3 NheI F (SEQ ID NO:283) and 1523 XhoI Stop R (SEQ ID NO:284). The PCR product was cleaved with NheI\XhoI restriction enzymes and ligated in to the pET24b+ vector (novagen) previously digested with the same restriction enzymes. The ligation reaction was transformed in DH5a E. coli cells and the correct sequence of the clones was verified by DNA sequencing.

The pET24-59(6XD3)-GSG4-1523 clone (kanamycin resistance) was transformed in BL21(DE3) t1 resistant strain (NEB). Protein expression was achieved by inoculating one single colony in LB-PTK+kanamycin medium and inducing protein expression by the addition of IPTG.

For the recombinant protein expression, the cultures were maintained at 25° C. for 5h after induction with 1 mM IPTG for the pET clones. All recombinant proteins were purified by affinity chromatography and gel filtration. Briefly, cells were harvested by centrifugation and lysed in "lysis buffer", containing 10 mM imidazole, 1 mg\ml lysozyme, 0.5 mg\ml DNAse and COMPLETE inhibitors cocktail (Roche) in PBS. The lysate was clarified by centrifugation and applied onto His-Trap HP column (Armesham Biosciences) pre-equilibrated in PBS containing 10 mM imidazole. Protein elution was performed using the same buffer containing 250 mM imidazole, after two wash steps using 20 mM and 50 mM imidazole buffers. The eluted proteins were then concentrated and loaded onto HiLoad 16/60 Superdex 75 (Amersham Biosciences) pre-equilibrated in PBS.

Example 2: Immunisation with GBS59(6XD3)-GBS1523 Provides Protection

The GBS59(6XD3)-GBS1523-HIS fusion was tested for its ability to provide protection against a range of GBS challenge strains. Separate groups of mice were immunised with the GBS59(6XD3)-GBS1523-HIS fusion and were then challenged with different GBS challenge strains that express different GBS59 alleles, or express GBS1523. Immunisation with PBS was used as a negative control. As shown in Table 5, the presence of GBS59 and GBS1523 antigens in the fusion provided protection against strains that express GBS59, and against strains that express GBS1523.

TABLE 5

| Challenge strain | GBS59 allele | PBS | | GBS59(6XD3)-GBS1523-HIS | |
|---|---|---|---|---|---|
| | | Protected/treated | % survival | Protected/treated | % survival |
| 5401 (H36B allele) | GBS59 (H36B) | 8/57 | 14 | 22/47 | 47 |
| 3050 (2603 allele) | GBS59 (2603) | 1/60 | 2 | 50/50 | 100 |
| 515 (515 allele) | GBS59 (515) | 11/30 | 36 | 49/58 | 85 |
| DK21 (DK21 allele) | GBS59 (DK21) | 7/30 | 23 | 28/37 | 76 |
| COH1 | GBS1523 | 10/50 | 20 | 55/60 | 92 |
| A909 | GBS1523 | 27/79 | 34 | 58/70 | 83 |

Importantly, the fusion comprising GBS1523 provided protection comparable to that obtained with the GBS59 (6XD3) fusion disclosed in WO2011/121576 against strains expressing different GBS59 alleles demonstrating that addition of GBS1523 does not negatively impact immunogenicity.

Example 3: GBS59(6XD3)-GBS1523 Conjugate as a Carrier for GBS PS-II

The efficacy of the GBS59(6XD3)-GBS1523 conjugate as a carrier for GBS type II polysaccharide was compared to other carrier proteins. Groups of mice were administered three doses of the relevant saccharide conjugate in Alum at a dose of 1 µg protein per dose. As shown in Table 6, the GBS59(6XD3)-GBS1523 conjugate is a particularly effective carrier for GBS type II polysaccharide and 100% of mice immunised with GBS59(6XD3)-GBS1523-II survived challenge with GBS type II strain 5401. Notably, the protection provided by GBS59(6XD3)-GBS1523-II was greater than the protection provided by CRM-II (85% survival) and greater than the protection provided by GBS80-II (78% survival). In addition, GBS59(6XD3)-GBS1523-II provided good protection against challenge by type III strain COH1 (100% survival) and type Ia strain 515 (40% survival).

TABLE 6

| | 5401 - type II | | COH1 - type III | | 515 - type Ia | |
|---|---|---|---|---|---|---|
| Antigen | Protected/treated | % survival | Protected/treated | % survival | Protected/treated | % survival |
| PBS/Alum | 17/118 | 14 | 29/110 | 26 | 2/50 | 4 |
| CRM-II | 85/100 | 85 | ND | ND | ND | ND |
| GBS80-II | 36/46 | 78 | 8/10 | 80 | ND | ND |
| GBS59(6XD3)-GBS1523-II | 60/60 | 100 | 40/40 | 100 | 28/70 | 40 |

Figure 2:
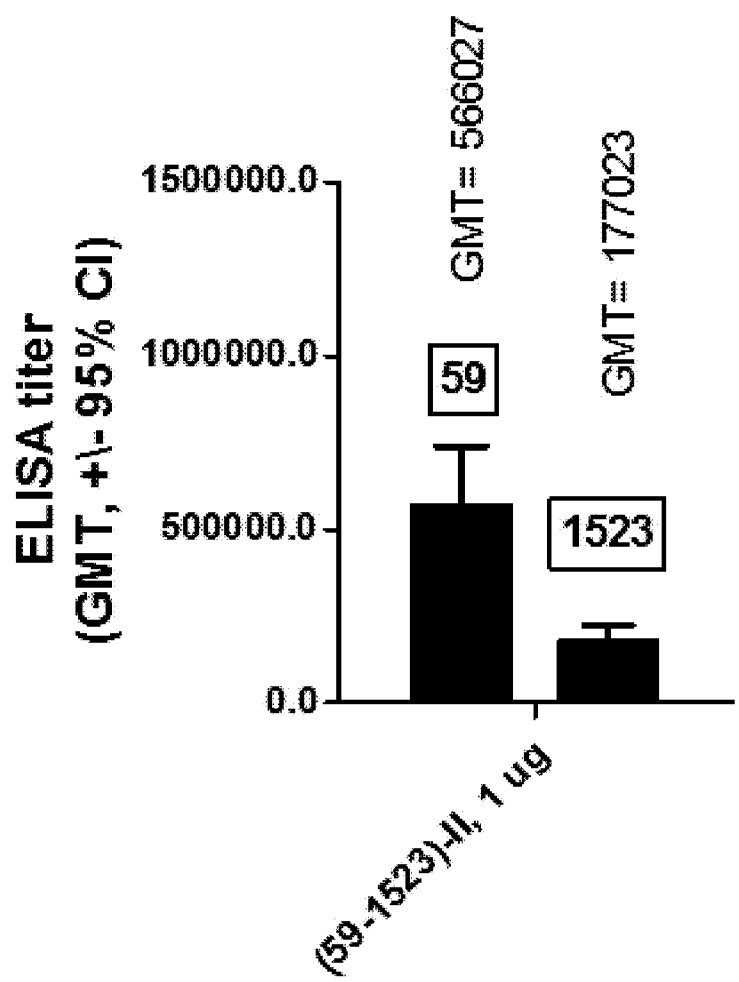
FIG. 2 displays the titre of antibodies specific for GBS59 and GBS1523 elicited by the GBS59(6XD3)-GBS1523-II conjugate compositions, in two studies. NB: in this example the BP-2a/spb1 carrier is referred to as GBS59(6XD3)-GBS1523.

The titre of antibodies specific for type II saccharide elicited by the compositions are shown in FIG. 1. GBS59 (6XD3)-GBS1523-II elicited high titres of specific antibodies and the titres are comparable to or higher than the titres elicited by CRM-II. Again, these data are significant, because they indicate that the increased protection exhibited by GBS59(6XD3)-GBS1523-II relative to, for example, CRM-II is not merely a result of the presence of carrier proteins that comprise GBS antigens. In contrast, the GBS59 (6XD3)-GBS1523 conjugate is effective as a carrier molecule and enhances the immune response that is specific for the type II saccharide antigen. The titre of antibodies specific for GBS59 and GBS1523 elicited by the GBS59(6XD3)-GBS1523-II compositions are shown in FIG. 2.

Example 4: GBS59(6XD3)-GBS1523 Conjugate as a Carrier for GBS PS-V

The efficacy of the GBS59(6XD3)-GBS1523 conjugate as a carrier for GBS type V polysaccharide was compared to other carrier proteins. Groups of mice were administered three doses of the relevant saccharide conjugate in Alum at a dose of 1 µg protein per dose. As shown in Table 7, the GBS59(6XD3)-GBS1523 conjugate is a particularly effective carrier for GBS type V polysaccharide and 86% of mice immunised with GBS59(6XD3)-GBS1523-V survived challenge with GBS type V strain CJB111. In addition, GBS59 (6XD3)-GBS1523-V provided good protection against challenge by type III strain COH1 (60% survival).

TABLE 7

| Antigen | CJB111 - type V | | COH1 - type III | |
|---|---|---|---|---|
| | Protected/treated | % survival | Protected/treated | % survival |
| PBS/Alum | 23/107 | 21 | 26/115 | 23 |
| GBS59(6XD3)-GBS1523-V | 43/50 | 86 | 34/57 | 60 |

Example 5: Efficacy of GBS59(6XD3)-GBS1523 vs Tetanus Toxoid, CRM197 and GBS80 as Carriers The efficacy of the GBS59(6XD3)-GBS1523 conjugate as a carrier for GBS type II and type V polysaccharides was also compared to TT, CRM197 and GBS80. Groups of 8 mice were administered three doses of the relevant saccharide conjugate in Alum at a dose of 1 µg saccharide and 400 µg Alum per dose As shown in Table 8, immunisation with GBS59(6XD3)-GBS1523-II provided greater protection against challenge with type II strain 5401 than CRM-II and GBS80-II, and also greater protection than TT-II.

TABLE 8

| Antigen | PBS/Alum | TT-II | CRM-II | GBS80-II | GBS59(6XD3)-GBS1523-II |
|---|---|---|---|---|---|
| % survival | 30 | 80 | 70 | 62 | 91 |

| Antigen | PBS/Alum | TT-V | CRM-V | GBS80-V | GBS59(6XD3)-GBS1523-V |
|---|---|---|---|---|---|
| % survival | 40 | 98 | 91 | 90 | 93 |

Figure 3:
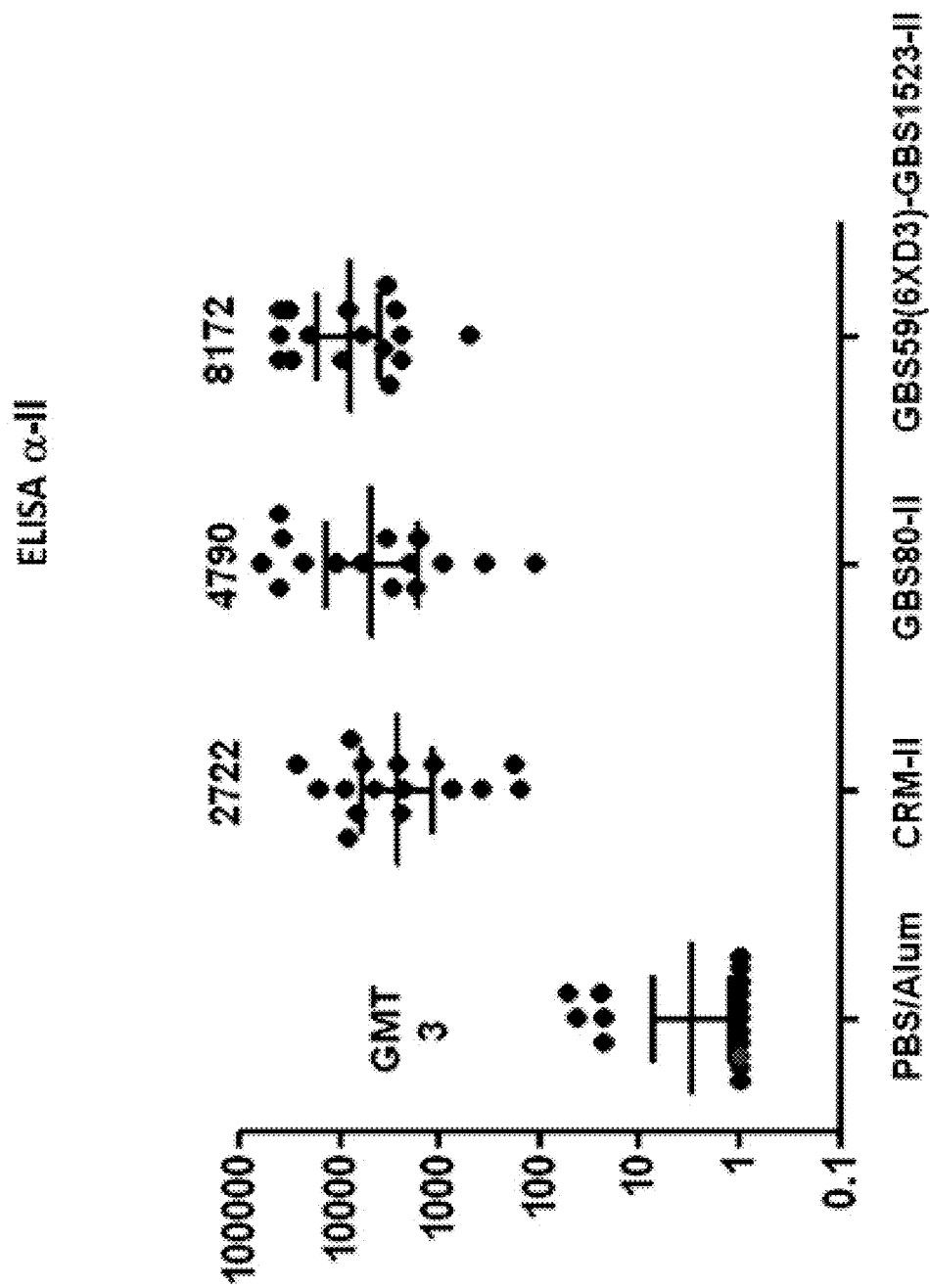
FIG. 3 compares the anti-serotype-II saccharide antibody titres elicited by immunisation with conjugates comprising serotype-II saccharide and CRM197, GBS80 and BP-2a/spb1 carriers.

FIG. 3 provides the geometric mean titres of anti-II saccharide antibodies elicited by the different conjugates in this study. The titres elicited by GBS59(6XD3)-GBS1523-II were greater than CRM-II and GBS80-II. These data are significant, because they indicate that the increased protection exhibited by GBS59(6XD3)-GBS1523-II relative to, for example, CRM-II is not merely a result of the presence of carrier proteins that comprise GBS antigens. In contrast, the GBS59(6XD3)-GBS1523 conjugate is effective as a carrier molecule and enhances the immune response that is specific for the type II saccharide antigen.

Figure 4:
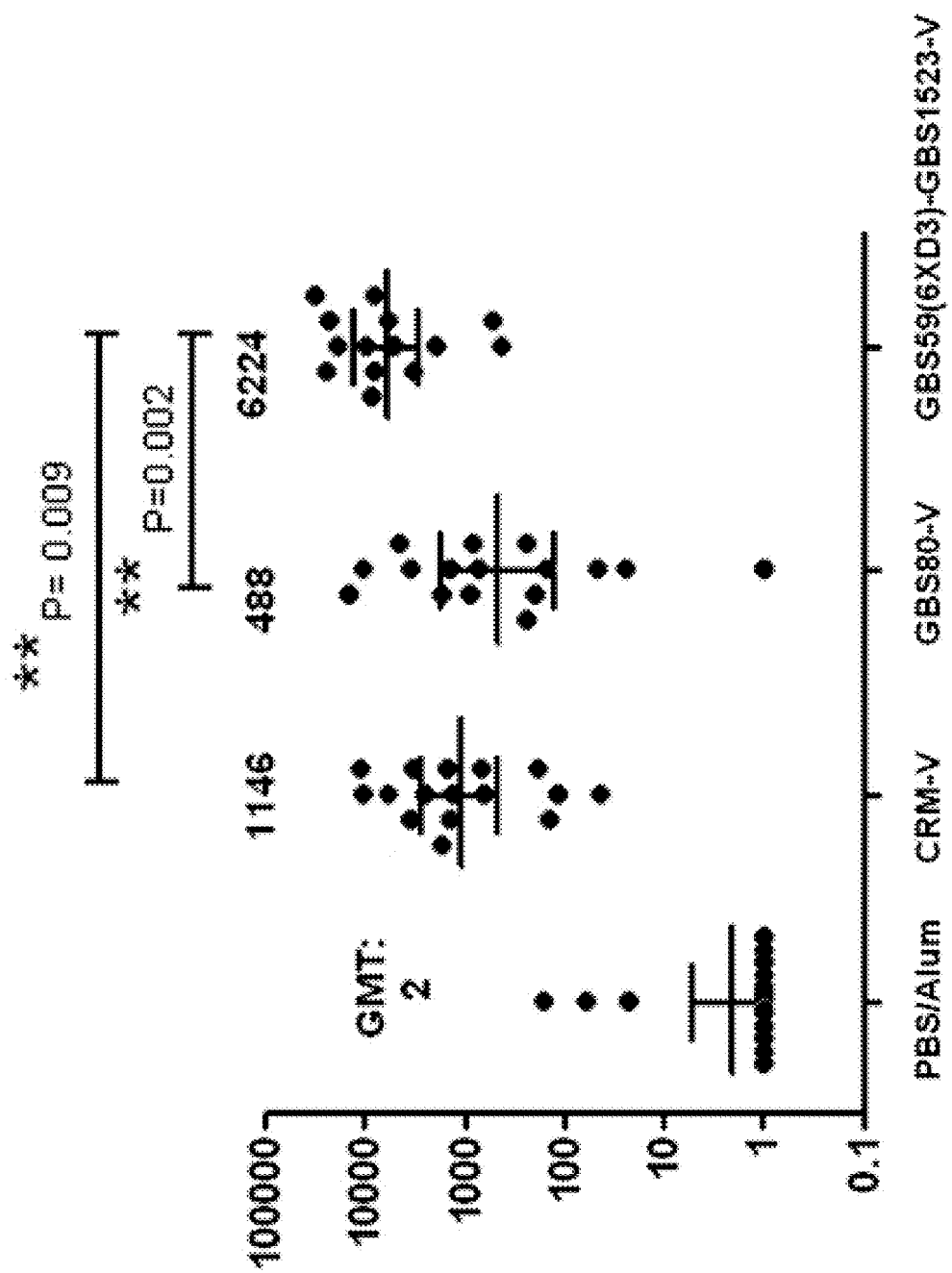
FIG. 4 compares the anti-type-V saccharide antibody titres elicited by immunisation with conjugates comprising serotype-V saccharide and CRM197, GBS80 and BP-2a/spb1 carriers.

FIG. 4 provides the geometric mean titres of anti-V saccharide antibodies elicited by the different conjugates in this study. The titres elicited by GBS59(6XD3)-GBS1523-V were greater than CRM-V and GBS80-V. These data are significant, because they indicate that the increased protection exhibited by GBS59(6XD3)-GBS1523-V relative to, for example, CRM-V is not merely a result of the presence of carrier proteins that comprise GBS antigens. In contrast, the GBS59(6XD3)-GBS1523 conjugate is effective as a carrier molecule and enhances the immune response that is specific for the type V saccharide antigen.

Figure 5:
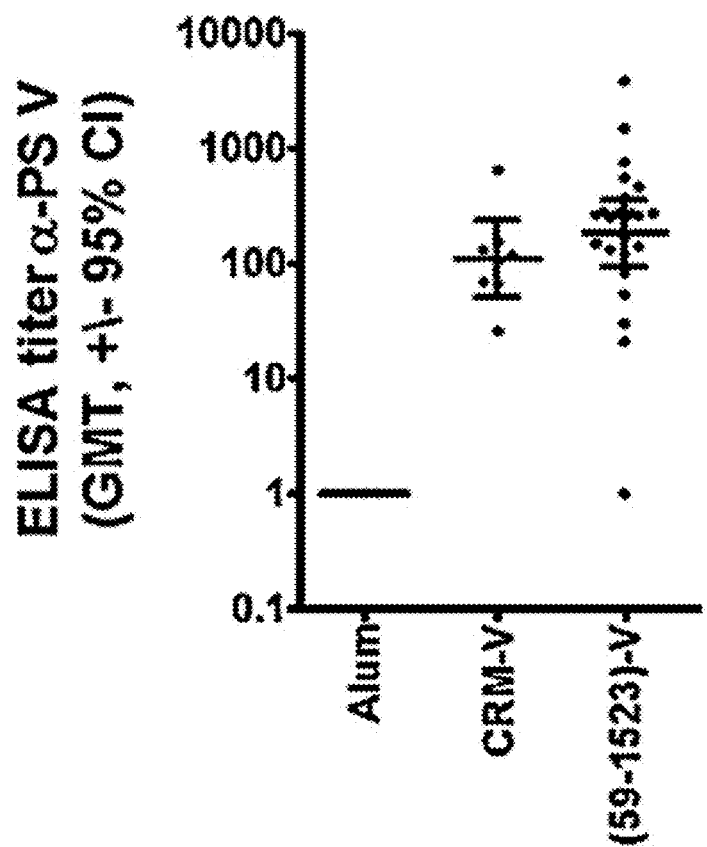
FIG. 5 compares the protection (lower rows of the table) and the anti-type-V saccharide antibody titres (graph and upper row of the table) elicited by immunisation with conjugates comprising serotype-V saccharide and $CRM_{197}$ and BP-2a/spb1 carriers. Compositions were administered at a dose of 1 µg protein.

The titre of antibodies specific for type V saccharide elicited by the compositions tested are shown in FIG. 5. GBS59(6XD3)-GBS1523-V elicited high titres of specific antibodies and the titres are comparable or higher than the titres elicited by CRM-V. Again, these data are significant, because they indicate that the increased protection exhibited by GBS59(6XD3)-GBS1523-V relative to, for example, CRM-V is not merely a result of the presence of carrier proteins that comprise GBS antigens. In contrast, the GBS59(6XD3)-GBS1523 conjugate is effective as a carrier molecule and enhances the immune response that is specific for the type V saccharide antigen.

Figure 6:
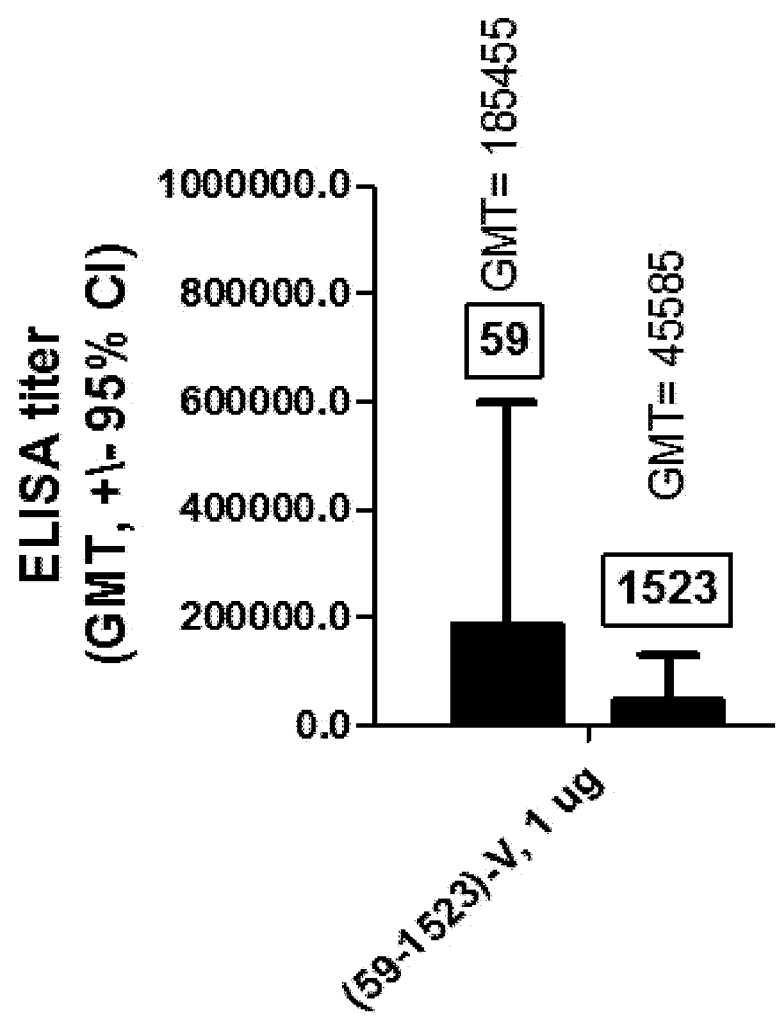
FIG. 6 displays the titre of antibodies specific for GBS59 and GBS1523 elicited by the GBS59(6XD3)-GBS1523-V conjugate compositions, in two studies. NB: in this example the BP-2a/spb1 carrier is referred to as GBS59(6XD3)-GBS1523.

The titre of antibodies specific for GBS59 and GBS1523 elicited by the GBS59(6XD3)-GBS1523-V compositions are shown in FIG. 6.

Example 6: Not all GBS Proteins are Effective Carrier Proteins

Figure 7:
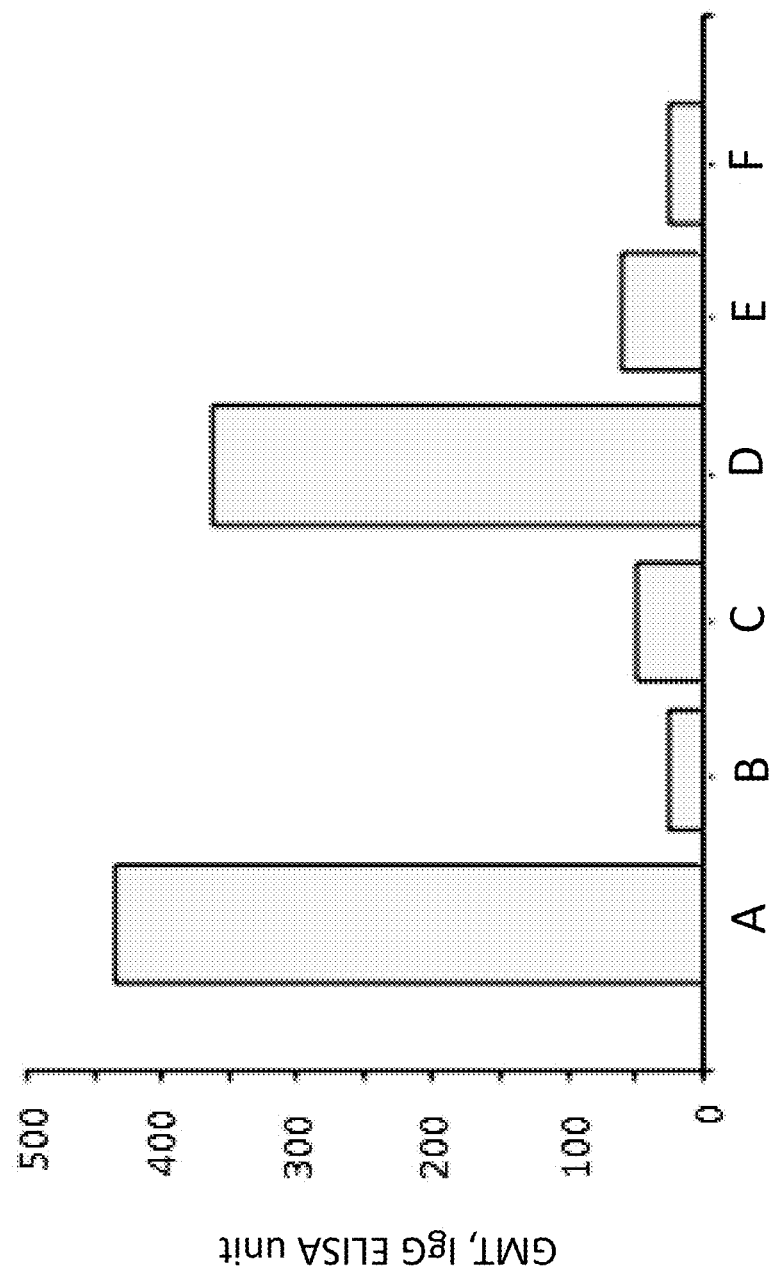
FIG. 7 shows the IgG response generated by different carrier protein conjugates in a model system using Laminarin and demonstrates that not all protein antigens are suitable for use as carriers (A=CRM197; B=GBS01132; C=GBS01157; D=GBS52; E=GBS150; F=SAN1516).

The ability of other GBS proteins to function as carrier proteins was tested using Laminarin as a capsular polysaccharide model. The following proteins, including ancillary proteins from the GBS pilus island, were conjugated to Laminarin and used to immunise mice as previously described: CRM197, GBS01132, GBS01157, GBS52 (uniprot Q8E0S8), GBS150 and SAN1516. Only one protein (GBS52) was able to function as a carrier protein eliciting anti-laminarin IgG titers comparable to those of the laminarin-CRM197 conjugate used as a benchmark (FIG. 7). Thus, the ability of GBS protein antigens to function as carrier proteins in place of, for example, CRM197 is independent of their ability to induce an immune response.

Example 7: GBS59(6XD3)-GBS1523 Conjugate as a Carrier in Multivalent Vaccines—Protection The GBS59(6XD3)-GBS1523 conjugate was tested for its efficacy when used in combination with other carrier-saccharide conjugates. In particular, GBS59(6XD3)-GBS1523-II and GBS59(6XD3)-GBS1523-V conjugates were combined with a trivalent vaccine comprising Ia, Ib and III GBS saccharides conjugated to CRM, and with GBS80 conjugates. The protection provided by these tetravalent and pentavalent compositions was compared to compositions comprising the trivalent vaccine in combination with serotype-II and -V saccharides conjugated to CRM197 and GBS80.

TABLE 9

| challenge with strain 5401 - type II | | |
|---|---|---|
| Antigens | Protected/treated | % survival |
| PBS | 37/120 | 31 |
| CRM-II | 55/80 | 69 |
| GBS80-II | 80/130 | 67 |
| GBS59(6XD3)-GBS1523-II | 108/120 | 90 |
| CRM-Ia/Ib/III | 15/100 | 15 |
| CRM-Ia/Ib/III + CRM-II | 72/99 | 73 |
| CRM-Ia/Ib/III + CRM-II + CRM-V | 62/129 | 48 |
| CRM-Ia/Ib/III + GBS80-II | 84/96 | 87 |
| CRM-Ia/Ib/III + GBS59(6XD3)-GBS1523-V + GBS80-II | 103/105 | 98 |
| CRM-Ia/Ib/III + GBS59-1523-II | 68/84 | 81 |
| CRM-Ia/Ib/III + GBS59(6XD3)-GBS1523-II + GBS80-V | 47/49 | 96 |

TABLE 10

| challenge with strain CJB111 - type V | | |
|---|---|---|
| Antigens | Protected/treated | % survival |
| PBS | 39/100 | 39 |
| CRM-V | 108/119 | 91 |
| GBS80-V | 114/127 | 90 |
| GBS59(6XD3)-GBS1523-V | 99/109 | 91 |

TABLE 10-continued challenge with strain CJB111 - type V

| Antigens | Protected/treated | % survival |
|---|---|---|
| CRM-Ia/Ib/III | 32/102 | 31 |
| CRM-Ia/Ib/III + CRM-V | 60/70 | 86 |
| CRM-Ia/Ib/III + CRM-II + CRM-V | 89/95 | 94 |
| CRM-Ia/Ib/III + GBS80-V | 82/90 | 91 |
| CRM-Ia/Ib/III + GBS59(6XD3)-GBS1523-II + GBS80-V | 60/60 | 100 |
| CRM-Ia/Ib/III + GBS59-1523-V | 79/98 | 81 |
| CRM-Ia/Ib/III + GBS59(6XD3)-GBS1523-V + GBS80-II | 99/120 | 82 |

Tables 9 and 10 demonstrate the efficacy of the GBS59 (6XD3)-GBS1523 conjugate as a carrier for both type-II and -V saccharides, when administered alone or in combination with other saccharide conjugates. GBS59(6XD3)-GBS1523-II provides better protection against serotype-II strain 5401 than CRM-II and GBS80-II when the conjugates are administered individually (90% survival compared to 67% and 69%). The improved protection against serotype-II strain 5401 is maintained when GBS59(6XD3)-GBS1523-II conjugates are combined with the trivalent CRM-Ia/Ib/III composition. A tetravalent composition comprising GBS59 (6XD3)-GBS1523-II and CRM-Ia/Ib/III provides higher protection than a composition comprising CRM-II and CRM-Ia/Ib/III (81% survival compared to 73% survival). This protection is increased further when GBS80-V is added to generate a pentavalent composition (96% survival).

In addition, GBS59(6XD3)-GBS1523-V provides strong protection against serotype-V strain CJB111 that is comparable to the protection provided by CRM-V. GBS59(6XD3)-GBS1523-V is also effective when combined with the trivalent CRM-Ia/Ib/III composition to generate tetravalent and pentavalent compositions.

These data also suggest that multivalent compositions comprising the GBS59(6XD3)-GBS1523 carrier are particularly effective and do not suffer from carrier-induced suppression exhibited by compositions relying on prior art carrier CRM. A significant amount of the protection against serotype-II strain 5401 was lost when high levels of CRM197 were used (protection decreased from 73% to 48%) in a mouse model, possibly due to carrier induced epitopic suppression (CIES). In contrast, Tables 9 and 10 demonstrate that each of the pentavalent compositions comprising GBS59(6XD3)-GBS1523 conjugates provided increased protection relative to the comparable tetravalent composition. This is a particularly advantageous attribute for a carrier molecule, and allows the development of effective multivalent compositions for providing protection against ranges of different organisms, and ranges of different strains of organisms.

The GBS59(6XD3)-GBS1523-II and GBS59(6XD3)-GBS1523-V conjugates were also tested for their ability to provide protection against heterologous strains when combined with the trivalent CRM-Ia/Ib/III composition and GBS80 conjugates. As shown in Tables 11 and 12 below, although protection provided by the conjugates was modest, it was greater than the protection provided by PBS and the GBS59(6XD3)-GBS1523 and GBS80 proteins themselves.

TABLE 11

Protection provided against other strains by multivalent vaccines

| Antigen | Challenge strain | Protected/treated | % survival |
|---|---|---|---|
| PBS | Type IV | 56/153 | 37 |
| CRM-Ia/Ib/III + GBS80-II + GBS59(6XD3)-GBS1523-V | Type IV | 83/122 | 68 |

TABLE 12

Protection provided against other strains by multivalent vaccines.

| Antigen | Challenge strain | Protected/treated | % survival |
|---|---|---|---|
| PBS | Type VIII | 28/90 | 31 |
| CRM-Ia/Ib/III + GBS80-II + GBS59(6XD3)-GBS1523-V | Type VIII | 61/97 | 63 |

Example 8: GBS59(6XD3)-GBS1523 Conjugate as a Carrier in Multivalent Vaccines—Antibody Titres In four further studies, the ability of the GBS59(6XD3)-GBS1523 conjugate to augment the antibody response to serotype-II and serotype-V saccharides in the context of multivalent vaccines was compared to CRM.

Figure 8:
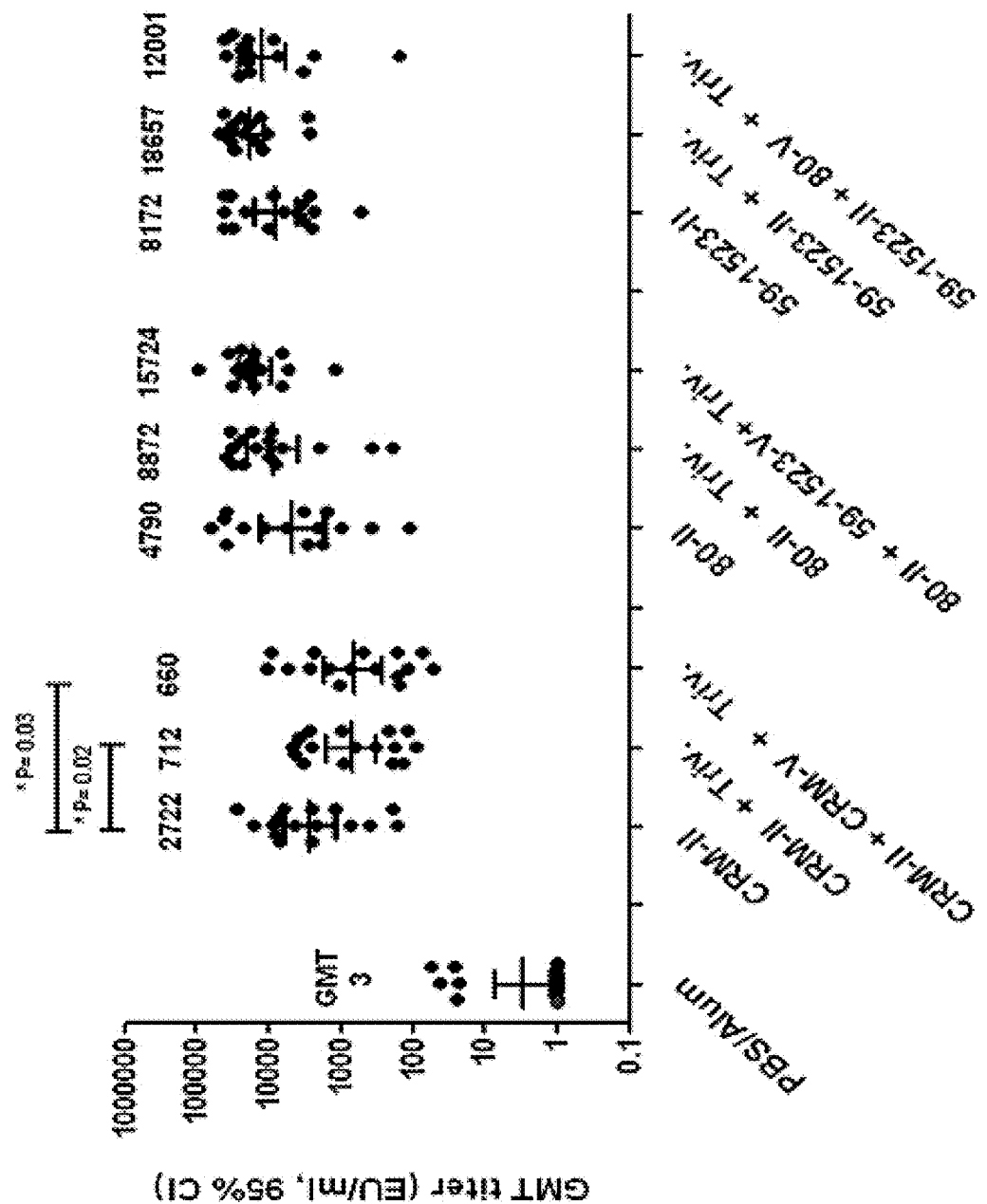
FIG. 8 compares the anti-type-II saccharide antibody titres elicited by immunisation with various mixtures of conjugates.

FIG. 8 shows the titres of antibodies specific for type II saccharide elicited by a range of different multivalent vaccine compositions ("Triv." refers to the CRM-Ia/Ib/III trivalent vaccine). The titre elicited by compositions comprising the GBS59(6XD3)-GBS1523 carrier was greater than that elicited by corresponding compositions comprising CRM-conjugates. Importantly, polysaccharide interference was not observed for the pentavalent GBS59(6XD3)-GBS1523 carrier compositions. In fully CRM197 conjugates compositions a more dispersed immune response is visible, potentially as a result of carrier immune epitope suppression from the high levels of CRM197 used in the specific mouse model.

Figure 9:
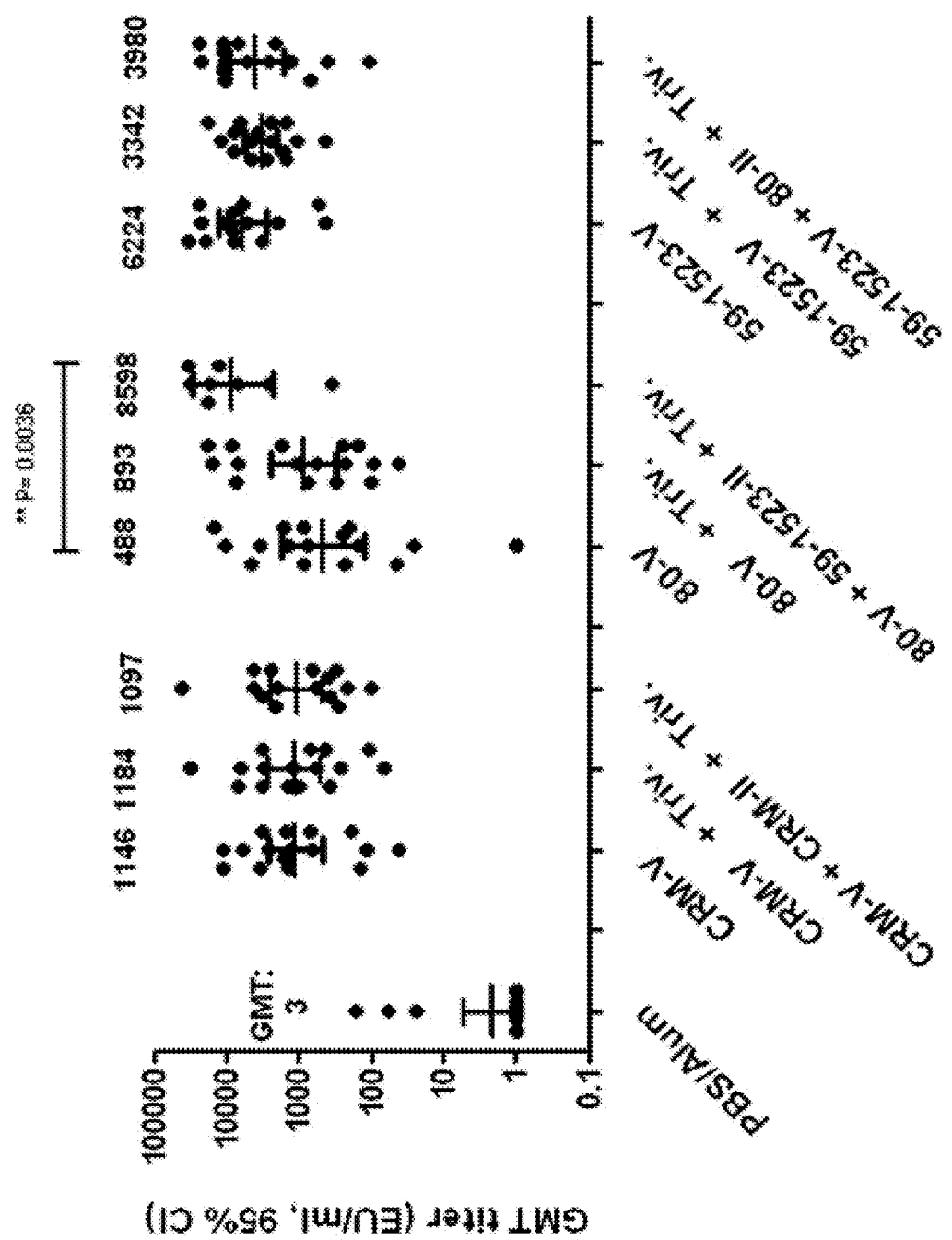
FIG. 9 compares the anti-type-V saccharide antibody titres elicited by immunisation with various mixtures of conjugates.

FIG. 9 shows the titres of antibodies specific for type V saccharide elicited by a range of different multivalent vaccine compositions ("Triv." refers to the CRM-Ia/Ib/III trivalent vaccine). The titre elicited by compositions comprising the GBS59(6XD3)-GBS1523 carrier was greater than that elicited by corresponding compositions comprising CRM-conjugates. Importantly, polysaccharide interference was not observed for the pentavalent GBS59(6XD3)-GBS1523 carrier compositions.

Figure 10:
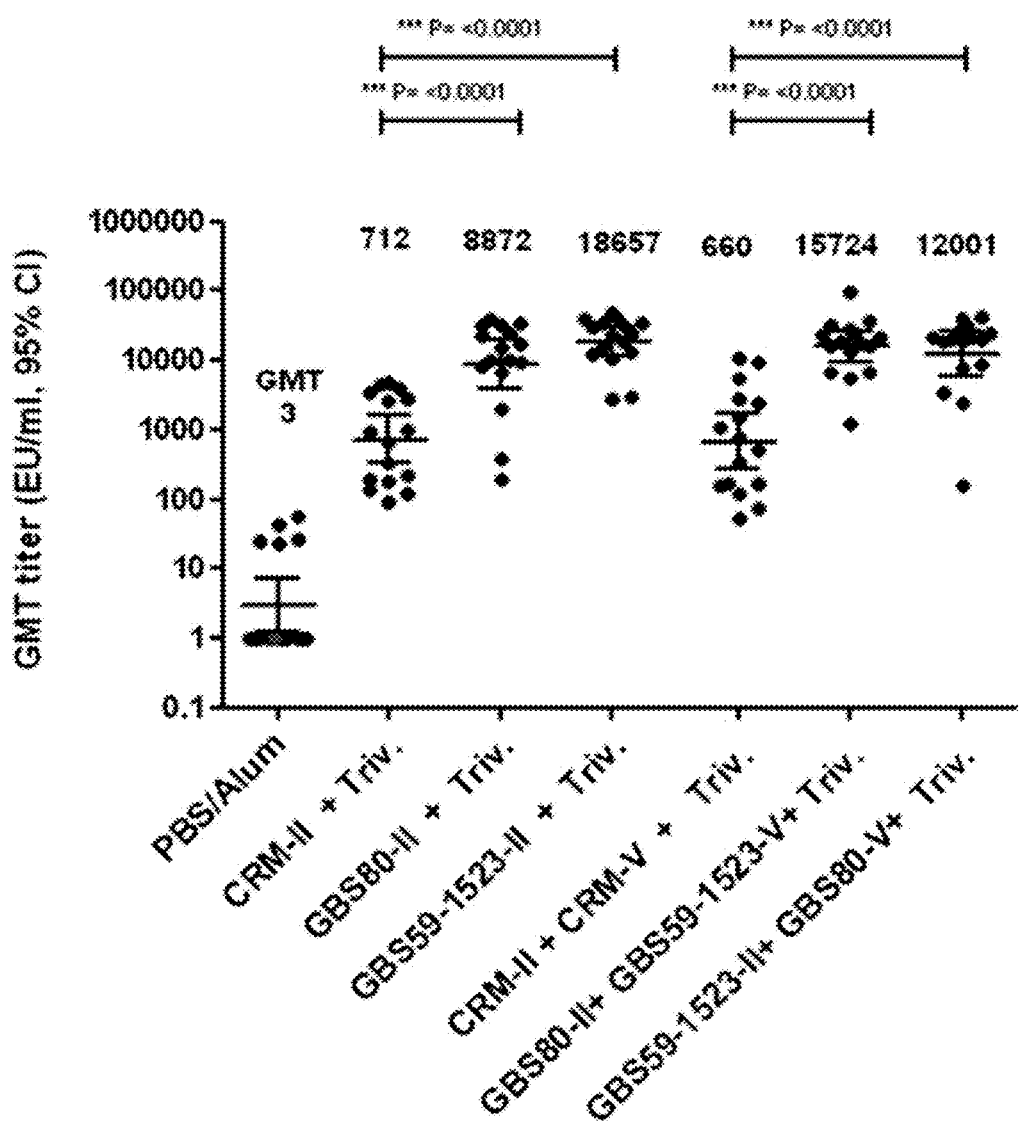
FIG. 10 presents some of the data of FIG. 8 and indicates certain statistically significant differences in antibody titres.
Figure 11:
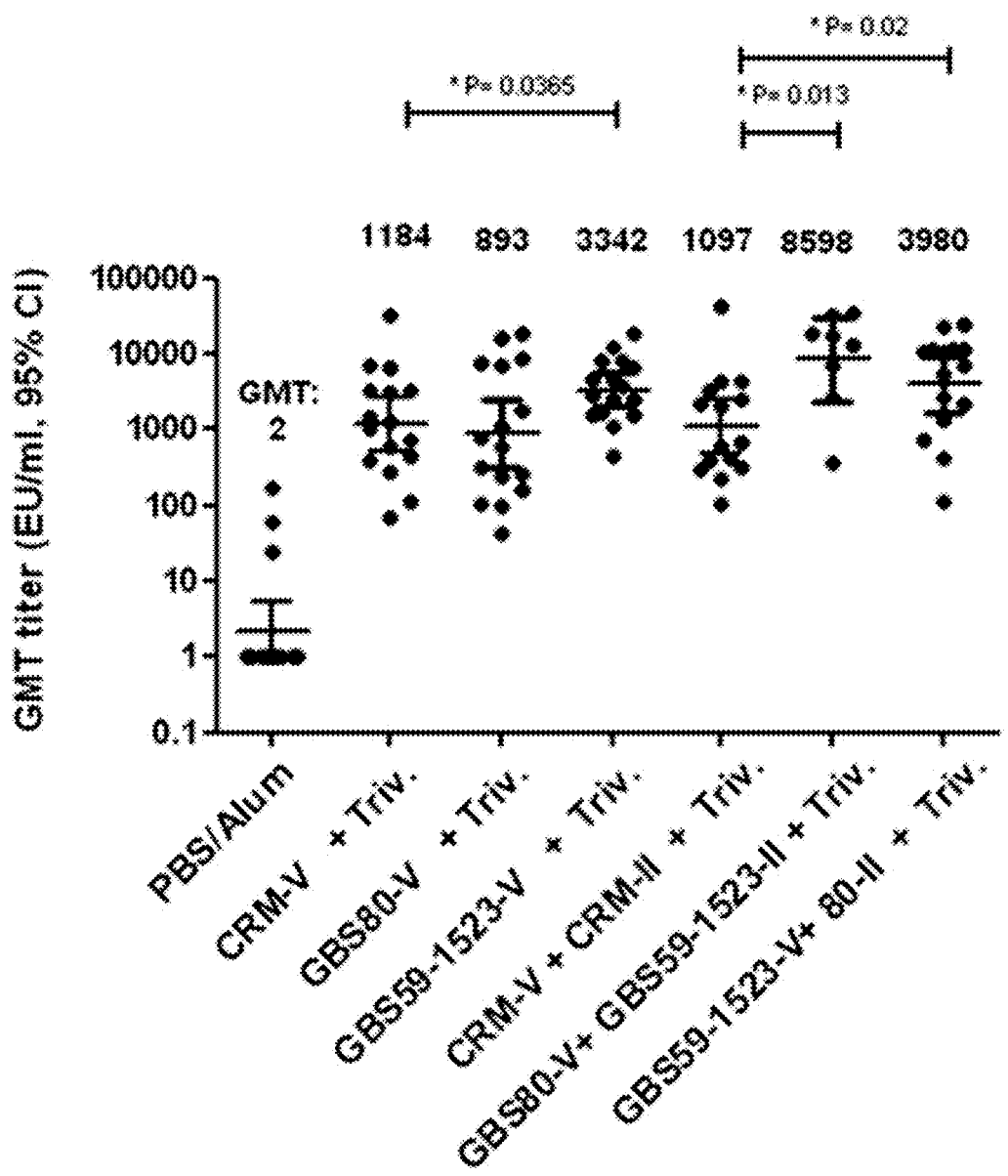
FIG. 11 presents some of the data of FIG. 9 and indicates certain statistically significant differences in antibody titres.

FIGS. 10 and 11 provide further statistical analysis of some of the data shown in FIGS. 8 and 9. It can be seen that the GBS59(6XD3)-GBS1523 carriers were statistically significantly more effective than the $CRM_{197}$ compositions.

As all GBS isolates carry pili, conferring protection in mice, the combination of three proteins (the backbone proteins of pilus 1 (GBS80) and 2b (GBS1523) and the chimeric fusion of 6 backbone variants of pilus 2a (GBS59)) can potentially protect against a broader range of GBS isolates, representing a more efficient solution for the prevention of GBS infections.

Compared to mixtures of three proteins, the fusion protein approach offers substantial advantages: it is a more defined product and it reduces the number of recombinant expression and purification steps, making the difference in terms of costs and feasibility for the vaccine. Fusion of pilus 2a chimeric protein with the pilus 2b backbone protein resulted in a highly expressed and stable antigen in which each domain folds individually correctly.

The recombinant chimera, alone or conjugated with GBS polysaccharides, conferred strong protection in mice challenged with any of the GBS strains carrying pilus 2b or pilus 2a variants.

Example 9—Domains of spb1(BP-2b, GBS1523)

Epitopes inducing protective immune responses are restricted to specific domains within an immunogenic protein. Once the domains are identified, they can be expressed in a recombinant form, for use as vaccine antigens devoid of regions that are irrelevant from a vaccine standpoint. One of the advantages of working with protein domains is that they are typically structurally ordered, and can be easily handled in vitro, further simplifying the construction of synthetic fusion proteins hosting two or more immunogenic domains. Therefore, to determine if the spb1(GBS1523) region of the fusion protein could be further optimised, structural vaccinology was applied to define the minimal domain carrying the protective epitopes.

Cloning, Expression and Purification of Recombinant Proteins

Genes coding for the pilus 2b backbone protein BP-$2b_{30-468}$ (full length spb1) without the predicted N-terminal signal peptide and the C-terminal transmembrane domain, and for BP-$2b_{185-468}$ (BP-$2b_{D2+D3}$, SEQ ID NO: 285), lacking the N-terminal domain 1, and the three single domains ($D1_{30-184}$, $D2_{185-356}$, $D_{347-468}$, SEQ ID NOs:287, 289, 291) were PCR amplified from GBS strain COH1 (SAN-_1518), cloned in the pET21b+ vector and expressed as C-terminal His-tagged proteins. Proteins were expressed in E. coli BL21(DE3) (Novagen) cells grown in LB, or in Biosilta Enbase media. The soluble proteins were extracted by using the cell lytic sigma reagent solubilized in Tris pH 7.5, 300 mM NaCl, 10 mM imidazole, and purified by a FF-Crude His-Trap HP nickel chelating column (Amersham Bioscience). The recombinant proteins, eluted with 300 mM imidazole, were concentrated by ultrafiltration to 10 mg\ml and loaded onto HiLoad 26/60 Superdex 75 (Amersham Biosciences) pre-equilibrated in 50 mM Tris-HCl (pH 7.5), 75 mM NaCl. The protein abundance in pure fractions was quantified with the BCA assay (Pierce).

Bacterial Strains, Media, and Growth Conditions immunized on days 1, 21 and 35 with either PBS or 20 μg of protein per dose in Alum formulations. Mice were bred 3 days after the last immunization. Within 48 h of birth, pups were injected intraperitoneally with a dose of GBS bacteria (COH1 strain) calculated to cause 90% lethality. Mice were monitored on a daily basis and euthanized when they exhibited defined humane endpoints that had been pre-established for the study in agreement with Novartis Animal Welfare Policies. Statistical analysis was performed using Fisher's exact test.

Construction of Complementation Vectors and Site-Directed Mutagenesis

To examine the possibility that monoclonal antibodies, targeting surface-exposed epitopes of the pilin protein BP, might recognize individual BP domains, BP full length protein, $BP_{D2+D3}$ and single domains D1, D2 and D3 were tested by western blotting.

Results obtained from immunoblotting with mAbs are shown in FIG. 13. Specific bands corresponding to the anticipated molecular weight of the D2+D3 protein fragment and the entire spb1 were observed with no detectable staining of the individual domains. As a control we used mouse sera raised against the full length recombinant BP, which is able to detect all recombinant subdomains of BP (data not shown). This result, suggests that monoclonal antibodies recognize epitopes which are included in full length and crystallized $BP_{D2+D3}$, but not in separated D2 and D3 domains. These data suggest that individual domains D2 or D3 do not fold correctly. Both antibodies can detect the full-length wild-type BP-2b protein; recombinant or native expressed by GBS and the recombinant D2+D3 protein fragment, but not the D2 or the D3 single recombinant domains.

$BP-2b_{D2+D3}$ Retains the Immunological Proprieties of Full Length Protein

Finally, in order to study the immunological properties of $BP_{D2+D3}$ compared with the full length protein and the single D1 domain, the purified recombinant proteins were independently used to immunize CD1 mice and the protection activity of each was tested in an active maternal mouse immunization/neonatal pup challenge model. For the challenge, we used the GBS strain COH1 expressing high level of BP-2b protein on its surface. As shown below, the $BP_{D2+D3}$ construct conferred in vivo protection to a level comparable to that of the full length protein, suggesting that protective epitopes in BP-2b are specifically concentrated in

| Protein | MW | Conc. BCA (mg/ml) | ABS 280 nm | ABS 0.1% | Conc 280 nm (mg/ml) | Conc mM |
|---|---|---|---|---|---|---|
| GBS 1523D2 His. | 19545 | 0.015 mg/ml | 0.097 | 1.044 | 0.0292 mg/ml | 0.00149 |
| GBS 59D3__H36B His | 12610.0 | 0.176 mg/ml | 0.121 | 0.791 | 0.153 mg/ml | 0.0121 |
| GBS 59D3__Cjb110 His. | 12675.1 | 0.247 mg/ml | 0.192 | 0.787 | 0.244 mg/ml | 0.0192 |
| GBS 59D3__Cjb111 His. | 12795.0 | 0.153 mg/ml | 0.208 | 1.209 | 0.172 mg/ml | 0.0134 |
| GBS 59D3__2603 His. | 12740.2 | 0.201 mg/ml | 0.177 | 0.783 | 0.226 mg/ml | 0.0177 |
| GBS 59D3__DK21 His. | 12697.9 | 0.121 mg/ml | 0.201 | 1.336 | 0.150 mg/ml | 0.0118 |
| GBS 59D3__515 His | 12656.9 | 0.105 mg/ml | 0.149 | 1.222 | 0.122 mg/ml | 0.00964 |
| GBS 59 (6xD3)-GSGS4-1523 | 125094 | 0.5 mg/ml | 0.446 | 1.072 | 0.416 mg/ml | 0.0033 |
| GBS 1523 | 47099 | 2.4 mg/ml | 1.70 | 1.195 | 1.4 mg/ml | 0.0297 |
| GBS 59 (6xD3) | 77771 | | 0.924 | 1.001 | 0.923 mg/ml | 0.0119 |
| GBS 1523 Dom 2-3 | 31500 | | 3.060 | 1.011 | 3.027 mg/ml | 0.0961 |

S. agalactiae strains were grown at 37° C. in 5% $CO_2$ in Todd Hewitt Broth (Difco Laboratories) or in trypticase soy agar supplemented with 5% sheep blood.

Mouse Active Maternal Immunization Model

Figure 14:
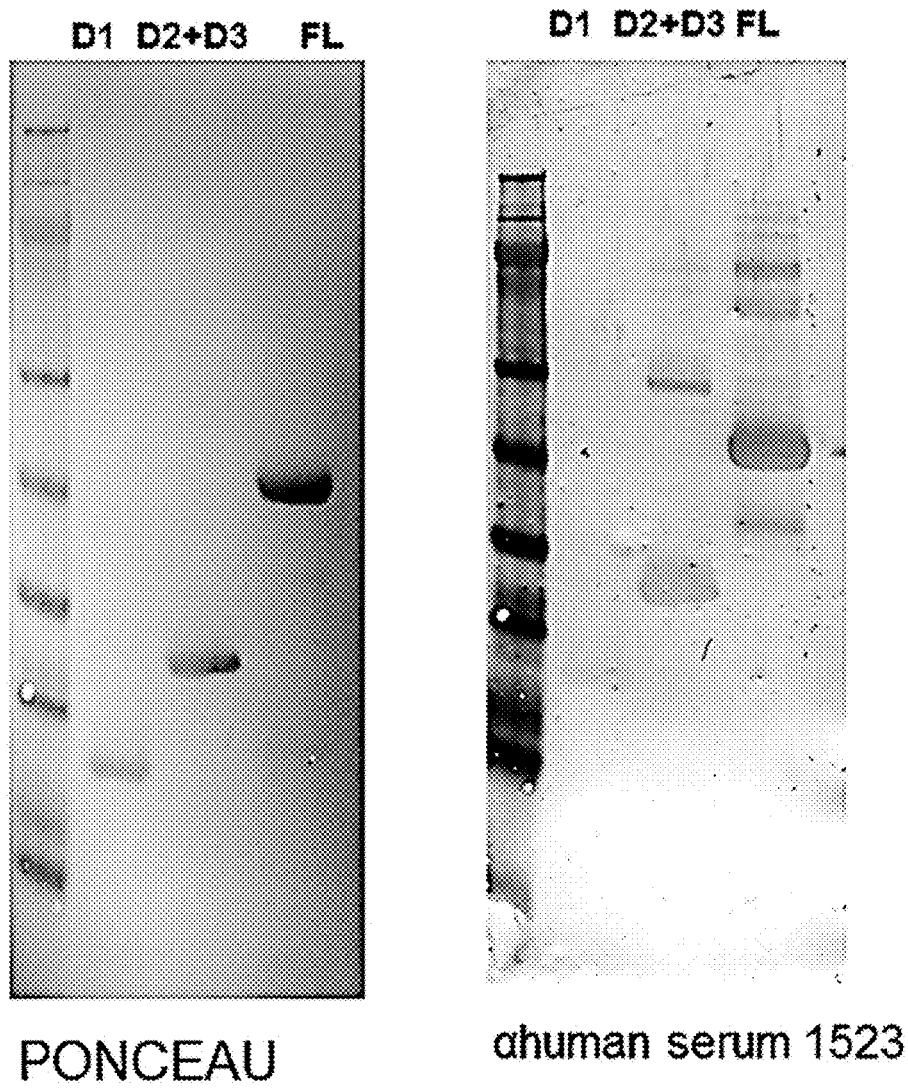
FIG. 14 presents western blotting with serum from human patient which strongly recognizes full length spb1 (GBS1523) and $spb1_{D2+D3}$ ($GBS1523_{D2+D3}$) but not $spb1_{D1}$ ($GBS1523_{D1}$).

A mouse maternal immunization/pup challenge model of GBS infection was used to verify the protective efficacy of the antigens, as previously described (Maione et al, 2005). In brief, groups of 5 CD-1 female mice (6-8 weeks old) were this portion of the protein, while the D1 domain appears dispensable for the protection in mice. FIG. 14 presents western blotting with serum from human patient which strongly recognizes full length spb1 (GBS1523) and $spb1_{D2+D3}$ ($GBS1523_{D2+D3}$) but not $spb1_{D1}$ ($GBS1523_{D1}$).

| BP-2b constructs | Alive/total | % survival |
|---|---|---|
| D1 | 24/143 | 17 |
| D2 + D3 | 69/106 | 65 |
| BP full length | 51/87 | 59 |
| PBS | 23/230 | 10 |

The sequence of an exemplary GBS59(6xD3)-GBS1523$_{D2+D3}$ is provided as SEQ ID:293. The sequence of a further exemplary carrier of the invention comprising the seven D3 subdomains of GBS59 and the D2+D3 domains of GBS1523, GBS59(7xD3SUB)-GBS1523$_{D2+D3}$, is provided as SEQ ID:294. Variant sequences of GBS1523 domains D1, D2 and D3 are provided in SEQ ID NOs:288, 290 and 292.

LIST OF SEQUENCES

SEQ ID NO:1 (GBS59 2603)
SEQ ID NO:2 (GBS59 515)
SEQ ID NO:3 (GBS59 cjb111)
SEQ ID NO:4 (GBS59 h36b)
SEQ ID NO:5 (GBS59 CJB110)
SEQ ID NO:6 (GBS59 DK21)
SEQ ID NO:7 (GBS59 NEM316)
SEQ ID NO:8 (D1 2603)
SEQ ID NO:9 (D2 2603)
SEQ ID NO:10 (D3 2603)
SEQ ID NO:11 (D4 2603)
SEQ ID NO:12 (D1 515)
SEQ ID NO:13 (D2 515)
SEQ ID NO:14 (D3 515)
SEQ ID NO:15 (D4 515)
SEQ ID NO:16 (cjb111 D1)
SEQ ID NO:17 (cjb111 D2)
SEQ ID NO:18 (cjb111 D3)
SEQ ID NO:19 (cjb111 D4)
SEQ ID NO:20 (h36b D1)
SEQ ID NO:21 (h36b D2)
SEQ ID NO:22 (h36b D3)
SEQ ID NO:23 (h36b D4)
SEQ ID NO:24 (CJB110 D1)
SEQ ID NO:25 (CJB110 D2)
SEQ ID NO:26 (CJB110 D3)
SEQ ID NO:27 (CJB110 D4)
SEQ ID NO:28 (DK21 D1)
SEQ ID NO:29 (DK21 D2)
SEQ ID NO:30 (DK21 D3)
SEQ ID NO:31 (DK21 D4)
SEQ ID NO:32 (D1 NEM316)
SEQ ID NO:33 (D2 NEM316)
SEQ ID NO:34 (D3 NEM316)
SEQ ID NO:35 (D4 NEM316)
SEQ ID NO:36 (2603 D3 sub-fragment)
SEQ ID NO:37 (2603 D4H)
SEQ ID NO:38 (515 D3 sub-fragment)
SEQ ID NO:39 (515 D4H)
SEQ ID NO:40 (cjb111 D3 sub-fragment)
SEQ ID NO:41 (cjb111 D4H)
SEQ ID NO:42 (h36b D3 sub-fragment)
SEQ ID NO:43 (h36b D4H)
SEQ ID NO:44 (CJB110 D3 sub-fragment)
SEQ ID NO:45 (CJB110 D4H)
SEQ ID NO:46 (DK21 D3 sub-fragment)
SEQ ID NO:47 (DK21 D4H)
SEQ ID NO:48 (NEM316 D3 sub-fragment)
SEQ ID NO:49 (DK21 D4H)
SEQ ID NO:50 (2603 D3+D4)
SEQ ID NO:51 (2603 D3+D4H)
SEQ ID NO:52 (2603 D2+D3+D4)
SEQ ID NO:53 (2603 D2+D3+D4H)
SEQ ID NO:54 (515 D3+D4)
SEQ ID NO:55 (515 D3+D4H)
SEQ ID NO:56 (515 D2+D3+D4)
SEQ ID NO:57 (515 D2+D3+D4H)
SEQ ID NO:58 (cjb111 D3+D4)
SEQ ID NO:59 (cjb111 D3+D4H)
SEQ ID NO:60 (cjb111 D2+D3+D4)
SEQ ID NO:61 (cjb111 D2+D3+D4H)
SEQ ID NO:62 (h36b D3+D4)
SEQ ID NO:63 (h36b D3+D4H)
SEQ ID NO:64 (h36b D2+D3+D4)
SEQ ID NO:65 (h36b D2+D3+D4H)
SEQ ID NO:66 (CJB110 D3+D4)
SEQ ID NO:67 (CJB110 D3+D4H)
SEQ ID NO:68 (CJB110 D2+D3+D4)
SEQ ID NO:69 (CJB110 D2+D3+D4H)
SEQ ID NO:70 (DK21 D3+D4)
SEQ ID NO:71 (DK21 D3+D4H)
SEQ ID NO:72 (DK21 D2+D3+D4)
SEQ ID NO:73 (DK21 D2+D3+D4H)
SEQ ID NO:74 (NEM316 D3+D4)
SEQ ID NO:75 (NEM316 D3+D4H)
SEQ ID NO:76 (NEM316 D2+D3+D4)
SEQ ID NO:77 (NEM316 D2+D3+D4H)
SEQ ID NO:78 (515 short fragment of D3)
SEQ ID NO:79 (his tag)
SEQ ID NO:80 (linker)
SEQ ID NO:81 (linker)
SEQ ID NO:82 (linker)
SEQ ID NO:83 (Fusion E)
SEQ ID NO:84 (Fusion F)
SEQ ID NO:85 (Fusion G)
SEQ ID NO:86 (Fusion H)
SEQ ID NO:87 (Fusion I)
SEQ ID NO:88 (encoding Fusion E)
SEQ ID NO:89 (encoding Fusion F)
SEQ ID NO:90 (encoding Fusion G)
SEQ ID NO:91 (encoding Fusion H)
SEQ ID NO:92 (encoding Fusion I)
SEQ ID NO:93 (encoding Fusion E—*E. Coli* optimised)
SEQ ID NO:94 (encoding Fusion F—*E. Coli* optimised)
SEQ ID NO:95 (encoding Fusion G—*E. Coli* optimised)
SEQ ID NO:96 (encoding Fusion H—*E. Coli* optimised)
SEQ ID NO:97 (encoding Fusion I—*E. Coli* optimised)
SEQ ID NO:98 (IC adjuvant)
SEQ ID NO:99 (Polycationic peptide adjuvant)
SEQ ID NO:100 (encoding GBS59 2603)
SEQ ID NO:101 (encoding GBS59 515)
SEQ ID NO:102 (encoding GBS59 cjb111)
SEQ ID NO:103 (encoding GBS59 h36b)
SEQ ID NO:104 (encoding GBS59 CJB110)
SEQ ID NO:105 (encoding GBS59 DK21)
SEQ ID NO:106 (encoding GBS59 NEM316)
SEQ ID NO:107 (encoding 2603 D1)
SEQ ID NO:108 (encoding 2603 D2)
SEQ ID NO:109 (encoding 2603 D3)
SEQ ID NO:110 (encoding 2603 D4)
SEQ ID NO:111 (encoding 515 D1)
SEQ ID NO:112 (encoding 515 D2)
SEQ ID NO:113 (encoding 515 D3)
SEQ ID NO:114 (encoding 515 D4)
SEQ ID NO:115 (encoding cjb111 D1)
SEQ ID NO:116 (encoding cjb111 D2)

SEQ ID NO:117 (encoding cjb111 D3)
SEQ ID NO:118 (encoding cjb111 D4)
SEQ ID NO:119 (encoding h36b D1)
SEQ ID NO:120 (encoding h36b D2)
SEQ ID NO:121 (encoding h36b D3)
SEQ ID NO:122 (encoding h36b D4)
SEQ ID NO:123 (encoding CJB110 D1)
SEQ ID NO:124 (encoding CJB110 D2)
SEQ ID NO:125 (encoding CJB110 D3)
SEQ ID NO:126 (encoding CJB110 D4)
SEQ ID NO:127 (encoding DK21 D1)
SEQ ID NO:128 (encoding DK21 D2)
SEQ ID NO:129 (encoding DK21 D3)
SEQ ID NO:130 (encoding DK21 D4)
SEQ ID NO:131 (encoding NEM316 D1)
SEQ ID NO:132 (encoding NEM316 D2)
SEQ ID NO:133 (encoding NEM316 D3)
SEQ ID NO:134 (encoding NEM316 D4)
SEQ ID NO:135 (encoding 2603 D3 sub-fragment)
SEQ ID NO:136 (encoding 2603 D4H)
SEQ ID NO:137 (encoding 515 D3 sub-fragment)
SEQ ID NO:138 (encoding 515 D4H)
SEQ ID NO:139 (encoding cjb111 D3 sub-fragment)
SEQ ID NO:140 (encoding cjb111 D4H)
SEQ ID NO:141 (encoding h36b D3 sub-fragment)
SEQ ID NO:142 (encoding h36b D4H)
SEQ ID NO:143 (encoding CJB110 D3 sub-fragment)
SEQ ID NO:144 (encoding CJB110 D4H)
SEQ ID NO:145 (encoding DK21 D3 sub-fragment)
SEQ ID NO:146 (encoding DK21 D4H)
SEQ ID NO:147 (encoding NEM316 D3 sub-fragment)
SEQ ID NO:148 (encoding NEM316 D4H)
SEQ ID NO:149 (encoding 2603 D3+D4)
SEQ ID NO:150 (encoding 2603 D3+D4H)
SEQ ID NO:151 (encoding 2603 D2+D3+D4)
SEQ ID NO:152 (encoding 2603 D2+D3+D4H)
SEQ ID NO:153 (encoding 515 D3+D4)
SEQ ID NO:154 (encoding 515 D3+D4H)
SEQ ID NO:155 (encoding 515 D2+D3+D4)
SEQ ID NO:156 (encoding 515 D2+D3+D4H)
SEQ ID NO:157 (encoding cjb111 D3+D4)
SEQ ID NO:158 (encoding cjb111 D3+D4H)
SEQ ID NO:159 (encoding cjb111 D2+D3+D4)
SEQ ID NO:160 (encoding cjb111 D2+D3+D4H)
SEQ ID NO:161 (encoding h36b D3+D4)
SEQ ID NO:162 (encoding h36b D3+D4H)
SEQ ID NO:163 (encoding h36b D2+D3+D4)
SEQ ID NO:164 (encoding h36b D2+D3+D4H)
SEQ ID NO:165 (encoding CJB110 D3+D4)
SEQ ID NO:166 (encoding CJB110 D3+D4H)
SEQ ID NO:167 (encoding CJB110 D2+D3+D4)
SEQ ID NO:168 (encoding CJB110 D2+D3+D4H)
SEQ ID NO:169 (encoding DK21 D3+D4)
SEQ ID NO:170 (encoding DK21 D3+D4H)
SEQ ID NO:171 (encoding DK21 D2+D3+D4)
SEQ ID NO:172 (encoding DK21 D2+D3+D4H)
SEQ ID NO:173 (encoding NEM316 D3+D4)
SEQ ID NO:174 (encoding NEM D3+D4H)
SEQ ID NO:175 (encoding NEM316 D2+D3+D4)
SEQ ID NO:176 (encoding NEM316 D2+D3+D4H)
SEQ ID NO:177 (GBS80 2603)
SEQ ID NO:178 (GBS80 2603 without leader)
SEQ ID NO:179 (GBS80 2603 without transmembrane/cytoplasmic region)
SEQ ID NO:180 (GBS80 2603 without transmembrane/cytoplasmic region and cell wall anchor)
SEQ ID NO:181 (GBS80 2603 without extracellular domain)
SEQ ID NO:182 (N-terminal immunogenic fragment of GBS80 2603)
SEQ ID NO:183 (GBS67 2603)
SEQ ID NO:184 (GBS67 2603 without transmembrane region)
SEQ ID NO:185 (GBS67 2603 without transmembrane and cell wall anchor motif)
SEQ ID NO:186 (N-terminal fragment of GBS67 2603)
SEQ ID NO:187 (N-terminal fragment of GBS67 2603)
SEQ ID NO:188 (GBS67 h36b)
SEQ ID NO:189 (N-terminal fragment of GBS67 h36b)
SEQ ID NO:190 (N-terminal fragment of GBS67 h36b)
SEQ ID NO:191 (GBS67 CJB111)
SEQ ID NO:192 (N-terminal fragment of GBS67 CJB111)
SEQ ID NO:193 (N-terminal fragment of GBS67 CJB111)
SEQ ID NO:194 (GBS67 515)
SEQ ID NO:195 (N-terminal fragment of GBS67 515)
SEQ ID NO:196 (N-terminal fragment of GBS67 515)
SEQ ID NO:197 (GBS67 NEM316)
SEQ ID NO:198 (N-terminal fragment of GBS67 NEM316)
SEQ ID NO:199 (N-terminal fragment of GBS67 NEM316)
SEQ ID NO:200 (GBS67 DK21)
SEQ ID NO:201 (N-terminal fragment of GBS67 DK21)
SEQ ID NO:202 (N-terminal fragment of GBS67 DK21)
SEQ ID NO:203 (GBS67 CJB110)
SEQ ID NO:204 (N-terminal fragment of GBS67 CJB110)
SEQ ID NO:205 (N-terminal fragment of GBS67 CJB110)
SEQ ID NO:206 (GBS1523 COH1)
SEQ ID NO:207 (GBS1523 COH1 without signal sequence region)
SEQ ID NO:208 (GBS1523 COH1 with mutation at position 41)
SEQ ID NO:209 (GBS80-GBS1523 hybrid)
SEQ ID NO:210 (GBS80-GBS1523 hybrid)
SEQ ID NO:211 (GBS80-GBS1523 hybrid)
SEQ ID NO:212 (GBS80-GBS1523 hybrid)
SEQ ID NO:213 (GBS104 2603)
SEQ ID NO:214 (GBS1524)
SEQ ID NO:215 (GBS3 2603)
SEQ ID NO:216 (GBS3 2603 without signal sequence region)
SEQ ID NO:217 (GBS3 2603 coiled coil and proline-rich segments)
SEQ ID NO:218 (GBS3 2603 signal sequence and coiled coil)
SEQ ID NO:219 (GBS3 2603 coiled coil segment)
SEQ ID NO:220 (GBS3 2603 signal sequence, coiled coil and proline rich segment)
SEQ ID NO:221 (GBS3 515)
SEQ ID NO:222 (GBS3 cjb111)
SEQ ID NO:223 (GBS3 coh1)
SEQ ID NO:224 (SAN1485 coh1)
SEQ ID NO:225 (GBS147 2603)
SEQ ID NO:226 (GBS328 2603)
SEQ ID NO:227 (GBS84 2603)
SEQ ID NO:228-261 (Primers)
SEQ ID NO:262 (4H11/B7-VH DNA sequence)
SEQ ID NO:263 (4H11/B7-VH amino acid sequence)
SEQ ID NO:264 (4H11/B7-VLk DNA sequence)
SEQ ID NO:265 (4H11/B7-VLk amino acid sequence)
SEQ ID NO:266 (17C4/A3-VH DNA sequence)
SEQ ID NO:267 (17C4/A3-VH amino acid sequence)
SEQ ID NO:268 (17C4/A3-VLk DNA sequence)
SEQ ID NO:269 (17C4/A3-VLk amino acid sequence)

SEQ ID NO:270 (epitope of D3 bound by 4H11/B7 and 17C4/A3)
SEQ ID NO:271 (RrgB)
SEQ ID NO:272 (GSGGGG linker)
SEQ ID NO:273 (GSGSGGGG linker)
SEQ ID NO:274 (linker with Leu-Glu dipeptide)
SEQ ID NO:275 (Histidine tag)
SEQ ID NO:276 (GBS59(6XD3)GBS1523)
SEQ ID NO:277 (GSGS linker)
SEQ ID NO:278 (PCR Primer 59pipeF)
SEQ ID NO:279 (PCR Primer 1523pipeR)
SEQ ID NO:280: (PCR Primer 59GSG41523.F)
SEQ ID NO:281: (PCR Primer 59GSG41523.R)
SEQ ID NO:282: (Overlapping Region)
SEQ ID NO:283: (PCR Primer 596xD3 NheI F)
SEQ ID NO:284: (PCR Primer 1523 XhoI Stop R)
SEQ ID NO:285: (GBS1523$_{D2+D3}$)
SEQ ID NO:286: (GBS1523$_{D2+D3}$ with additional N-terminal sequence)
SEQ ID NO:287: (GBS1523$_{D1}$)
SEQ ID NO:288: (GBS1523$_{D1}$ Variant)
SEQ ID NO:289: (GBS1523$_{D2}$)
SEQ ID NO:290: (GBS1523$_{D2}$ Variant)
SEQ ID NO:291: (GBS1523$_{D3}$)
SEQ ID NO:292: (GBS1523$_{D3}$ Variant)
SEQ ID NO:293: (GBS59(6xD3)-GBS1523$_{D2+D3}$ Fusion Protein)
SEQ ID NO:294: (GBS59(7xD3$_{SUB}$)-GBS1523$_{D2+D3}$ Fusion Protein)
SEQ ID NO:295:

REFERENCES

[1] Lindberg (1999) *Vaccine* 17 Suppl 2:S28-36
[2] Buttery & Moxon (2000) *J R Coll Physicians Lond* 34:163-8
[3] Ahmad & Chapnick (1999) *Infect Dis Clin North Am* 13:113-33, vii
[4] Goldblatt (1998) *J Med Microbial* 47:563-567
[5] EP-B-0 477 508
[6] U.S. Pat. No. 5,306,492
[7] WO 98/42721
[8] Dick et al. in *Conjugate Vaccines* (eds. Cruse et al.) Karger, Basel, 1989, Vol. 10, 48-114
[9] Hermanson, *Bioconjugate Techniques*, Academic Press, San Diego Calif. (1996)
[10] Ramsay et al. (2001) *Lancet* 357(9251):195-6
[11] Paoletti & Kasper (2003) *Expert Opin Biol Ther* 3:975-84.
[12] Prieler et al. (2006) 47th Annual ICAAC (abstract)
[13] Rennels et al. (2004) *Pediatr Infect Dis J* 23(5):429-35
[14] Snape et al. (2008) *JAMA* 299(2):173-84
[15] WO 2012/035519
[16] Dagan et al. (2010) *Vaccine* 28(34):5513-23. Epub 25 Jun. 2010
[17] WO 00/56360
[18] Rosini et al. (2006) *Molecular Microbiology* 61(1):126-141
[19] Margarit et al. (2009) *Journal of Infectious Diseases* 199:108-115
[20] Falugi et al. (2001) *Eur J Immunol.* 31(12):3816-24
[21] Geysen et al. (1984) *PNAS USA* 81:3998-4002
[22] Carter (1994) *Methods Mol Biol* 36:207-23
[23] Jameson, B A et al. (1988) *CABIOS* 4(1):181-186
[24] Raddrizzani & Hammer (2000) *Brief Bioinform* 1(2): 179-89
[25] De Lalla et al. (1999) *J. Immunol.* 163:1725-29
[26] Brusic et al. (1998) *Bioinformatics* 14(2):121-30
[27] Meister et al. (1995) *Vaccine* 13(6):581-91
[28] Roberts et al. (1996) *AIDS Res Hum Retroviruses* 12(7):593-610
[29] Maksyutov & Zagrebelnaya (1993) *Comput Appl Biosci* 9(3):291-7
[30] Feller & de la Cruz (1991) *Nature* 349(6311):720-1
[31] Hopp (1993) *Peptide Research* 6:183-190
[32] Welling et al. (1985) *FEBS Lett.* 188:215-218
[33] Davenport et al. (1995) *Immunogenetics* 42:392-297
[34] Nuccitelli et al. (2011) *Proc Natl Acad Sci U.S.A.* 108(25):10278-83
[35] Tettelin et al. (2005) *Proc Natl Acad Sci U.S.A.* 102(39):13950-13955
[36] Ravenscroft et al. (1999) *Vaccine* 17:2802-2816
[37] Costantino et al. (1999) *Vaccine* 17:1251-1263
[38] WO 02/058737
[39] U.S. Pat. No. 6,699,474
[40] WO 2006/050341
[41] Guttormsen et al. (2008) *Proc Natl Acad Sci USA.* 105(15):5903-8. Epub 31 Mar. 2008
[42] WO 96/40795
[43] Michon et al. (2006) *Clin Vaccine Immunol* 13(8):936-43
[44] Lewis et al. (2004) *Proc Natl Acad Sci USA.* 101: 11123-8
[45] Wessels et al. (1989) *Infect Immun* 57:1089-94
[46] WO 2006/082527
[47] WO 2009/081276
[48] Frash (1990) p. 123-145 of *Advances in Biotechnological Processes* vol. 13 (eds. Mizrahi & Van Wezel)
[49] WO 03/007985
[50] Inzana (1987) *Infect. Immun* 55:1573-1579
[51] WO 200/5103230
[52] Kandil et al. (1997) *Glycoconj J* 14:13-17
[53] Berkin et al. (2002) *Chemistry* 8:4424-4433
[54] Glode et al. (1979) *J Infect Dis* 139:52-56
[55] WO 94/05325; U.S. Pat. No. 5,425,946
[56] WO 2005/033148
[57] WO 03/080678.
[58] WO 2008/084411
[59] Nilsson & Svensson (1979) *Carbohydrate Research* 69:292-296
[60] Tokunaka et al. (1999) *Carbohydr Res* 316:161-172
[61] WO 03/097091
[62] Pang et al. (2005) *Biosci Biotechnol Biochem* 69:553-8
[63] Read et al. (1996) *Carbohydr Res* 281:187-201
[64] Takeo and Tei (1986) *Carbohydr Res.* 145:293-306
[65] Tanaka et al. (2003) *Tetrahedron Letters* 44:3053-3057
[66] Ning et al. (2002) *Tetrahedron Letters* 43:5545-5549
[67] Geurtsen et al. (1999) *Journal of Organic Chemistry* 64(21):7828-7835
[68] Wu et al. (2003) *Carbohydr Res.* 338:2203-12
[69] Nicolaou et al. (1997) *J. Am. Chem. Soc.* 119:449-450
[70] Yamada et al. (1999) *Tetrahedron Letters* 40:4581-4584
[71] Yamago et al. (2001) *Org Lett* 24:3867-3870
[72] Yuguo et al. (2004) *Tetrahedron* 60: 6345-6351
[73] Amaya et al. (2001) *Tetrahedron Letters* 42:9191-9194
[74] Mei et al. (2005) *Carbohydr Res.* 340:2345-2351
[75] Takeo et al. (1993) *Carbohydr Res.* 245:81-96
[76] Jamois et al. (2005) *Glycobiology* 15(4):393-407
[77] Lefeber et al. (2001) *Chem. Eur. J.* 7(20):4411-4421
[78] Huang et al. (2005) *Carbohydr Res.* 340:603-608
[79] U.S. Pat. No. 5,508,191
[80] MiKyoung et al. (2003) *Biochemical Engineering Journal* 16:163-8
[81] Barsanti et al. (2001) *J Appl Phycol* 13:59-65

[82] Bardotti et al. (2008) *Vaccine* 26:2284-96
[83] Jones (2005) *An Acad Bras Cienc* 77(2) 293-324
[84] Jones (2005) *J Pharm Biomed Anal* 38 840-850
[85] Moreau et al. (1990) *Carbohydrate Res* 339(5):285-91
[86] Fournier et al. (1984) *Infect Immun* 45(1):87-93
[87] Jones (2005) *Carbohydrate Res* 340(6):1097-106
[88] Fattom et al. (1998) *Infect Immun* 66(10):4588-92
[89] Lemercinier and Jones (1996) *Carbohydrate Res.* 296: 83-96
[90] Jones and Lemercinier (2002) *J Pharm Biomed Anal.* 30(4):1233-47
[91] WO 05/033148
[92] WO 00/56357
[93] Hestrin (1949) *J Biol Chem* 180:249-261
[94] Konadu et al. (1994) *Infect Immn.* 62:5048-5054
[95] Fattom et al. (1990) *Infect Immun* 58(7):2367-74
[96] Gilbert et al. (1994) *J Microb Meth* 20:39-46
[97] Kreis et al. (1995) *Int J Biol Macromol.* 17(3-4):117-30
[98] Höög et al. (2002) *Carbohydr Res* 337(21-23):2023-36
[99] www.polymer.de
[100] Lees et al. (1996) *Vaccine* 14:190-198
[101] WO 95/08348
[102] U.S. Pat. No. 4,761,283
[103] U.S. Pat. No. 4,356,170
[104] U.S. Pat. No. 4,882,317
[105] U.S. Pat. No. 4,695,624
[106] Porro et al. (1985) *Mol Immunol* 22:907-919
[107] EP-A-0208375
[108] Bethell G. S. et al. (1979) *J Biol Chem.* 254:2572-4
[109] Hearn (1981) *J Chromatogr* 218:509-18
[110] WO 00/10599
[111] Gever et al. (1979) *Med. Microbiol Immunol* 165:171-288
[112] U.S. Pat. No. 4,057,685
[113] U.S. Pat. Nos. 4,673,574; 4,761,283; 4,808,700
[114] U.S. Pat. No. 4,459,286
[115] U.S. Pat. No. 5,204,098
[116] U.S. Pat. No. 4,965,338
[117] U.S. Pat. No. 4,663,160
[118] WO 2007/000343
[119] WO 96/40242
[120] Lei et al. (2000) *Dev Biol (Basel)* 103:259-264
[121] WO 00/38711
[122] Karpovsky et al. (1984) *Exp Med* 160:1686
[123] Liu et al. (1985) *Proc Natl Acad Sci U.S.A.* 82:8648
[124] Paulus (1985) *Behring Ins Mitt* 78, 118-132
[125] Brennan et al. (1985) *Science* 229:81-83
[126] Glennie et al. (1987) *Immunol* 139: 2367-2375
[127] Wang et al. (2009) *Chem Biol* 16:323-336
[128] Floyd et al. (2009) *Angew Chem* 48:7798-7802
[129] *Research Disclosure*, 453077 (January 2002)
[130] EP-A-0372501
[131] EP-A-0378881
[132] EP-A-0427347
[133] WO 93/17712
[134] WO 94/03208
[135] WO 98/58668
[136] EP-A-0471177
[137] WO 91/01146
[138] Baraldo et al. (2004) *Infect Immun* 72(8):4884-7
[139] EP-A-0594610
[140] Ruan et al. (1990) *J Immunol* 145:3379-3384
[141] WO 00/56360
[142] WO 02/091998
[143] Kuo et al. (1995) *Infect Immun* 63:2706-13
[144] Michon et al. (1998) Vaccine 16:1732-41
[145] WO 01/72337
[146] WO 00/61761
[147] WO 2004/041157
[148] WO 02/34771
[149] WO 99/42130
[150] WO 2004/011027
[151] WO 03/093306
[152] WO 2004/018646
[153] WO 2004/041157
[154] Watson (2000) *Pediatr Infect Dis J* 19:331-332
[155] Rubin (2000) *Pediatr Clin North Am* 47:269-285,v
[156] Jedrzejas (2001) *Microbiol Mol Biol Rev* 65:187-207
[157] Bell (2000) *Pediatr Infect Dis J* 19:1187-1188
[158] Iwarson (1995) *APMIS* 103:321-326
[159] Gerlich et al. (1990) *Vaccine* 8 Suppl:S63-68 & 79-80
[160] Hsu et al. (1999) *Clin Liver Dis* 3:901-915
[161] Gustafsson et al. (1996) *N Engl J Med* 334:349-355
[162] Rappuoli et al. (1991) *TIBTECH* 9:232-238
[163] *Vaccines* (2004) eds. Plotkin & Orenstein. ISBN 0-7216-9688-0
[164] WO 99/24578
[165] WO 99/36544
[166] WO 99/57280
[167] WO00/22430
[168] Tettelin et al. (2000) *Science* 287:1809-1815
[169] Pizza et al. (2000) *Science* 287:1816-1820
[170] WO 02/02606
[171] Kalman et al. (1999) *Nature Genetics* 21:385-389
[172] Read et al. (2000) *Nucleic Acids Res* 28:1397-406
[173] Shirai et al. (2000) *J Infect Dis* 181(Suppl 3):S524-S527
[174] WO 99/27105
[175] WO 00/27994
[176] WO 00/37494
[177] WO 99/28475
[178] Ross et al. (2001) *Vaccine* 19:4135-4142
[179] Sutter et al. (2000) *Pediatr Clin North Am* 47:287-308
[180] Zimmerman & Spann (1999) *Am Fam Physician* 59:113-118, 125-126
[181] Dreesen (1997) *Vaccine* 15 Suppl:S2-6
[182] *MMWR Morb Mortal Wkly Rep* 1998 Jan. 16; 47(1): 12, 19
[183] McMichael (2000) *Vaccine* 19 Suppl 1:S101-107
[184] WO 02/34771
[185] Dale (1999) *Infect Dis Clin North Am* 13:227-43, viii
[186] Ferretti et al. (2001) *PNAS USA* 98:4658-4663
[187] Ichiman and Yoshida (1981) *J Appl Bacteriol* 51:229
[188] U.S. Pat. No. 4,197,290
[189] Ichiman et al. (1991) *J Appl Bacteriol* 71:176
[190] Robinson & Torres (1997) *Seminars in Immunology* 9:271-283
[191] Donnelly et al. (1997) *Annu Rev Immunol* 15:617-648
[192] Scott-Taylor & Dalgleish (2000) *Expert Opin Investig Drugs* 9:471-480
[193] Apostolopoulos & Plebanski (2000) *Curr Opin Mol Ther* 2:441-447
[194] Ilan (1999) *Curr Opin Mol Ther* 1:116-120
[195] Dubensky et al. (2000) *Mol Med* 6:723-732
[196] Robinson & Pertmer (2000) *Adv Virus Res* 55:1-74
[197] Donnelly et al. (2000) *Am J Respir Crit Care Med* 162(4 Pt 2):S190-193
[198] Davis (1999) *Mt. Sinai J. Med.* 66:84-90
[199] Gennaro (2000) *Remington: The Science and Practice of Pharmacy.* 20th edition, ISBN: 0683306472
[200] Almeida & Alpar (1996) *J. Drug Targeting* 3:455-467
[201] U.S. Pat. No. 6,355,271
[202] WO 00/23105
[203] U.S. Pat. No. 5,057,540

[204] WO 96/33739
[205] EP-A-0109942
[206] WO 96/11711
[207] WO 00/07621
[208] Barr et al. (1998) *Advanced Drug Delivery Reviews* 32:247-271
[209] Sjolanderet et al. (1998) *Advanced Drug Delivery Reviews* 32:321-338
[210] Pizza et al. (2000) *Int J Med Microbiol* 290:455-461
[211] WO 95/17211
[212] WO 98/42375
[213] Singh et al. (2001) *J Cont Release* 70:267-276
[214] WO 99/27960
[215] U.S. Pat. No. 6,090,406
[216] U.S. Pat. No. 5,916,588
[217] EP-A-0626169
[218] Dyakonova et al. (2004) *Int Immunopharmacol* 4(13):1615-23
[219] FR-2859633
[220] Signorelli & Hadden (2003) *Int Immunopharmacol* 3(8):1177-86
[221] WO 2004/064715
[222] De Libero et al. (2005) *Nature Reviews Immunology*, 5:485-496
[223] U.S. Pat. No. 5,936,076
[224] Oki et al. (2004) *J Clin Investig* 113:1631-1640
[225] US 2005/0192248
[226] Yang et al. (2004) *Angew Chem Int Ed*, 43:3818-3822
[227] WO 2005/102049
[228] Goff et al. (2004) *J Am Chem Soc* 126:13602-13603
[229] WO 03/105769
[230] Cooper (1995) *Pharm Biotechnol* 6:559-80
[231] Kandimalla et al. (2003) *Nucleic Acids Research* 31:2393-2400
[232] WO 02/26757
[233] WO 99/62923
[234] Krieg (2003) *Nature Medicine* 9:831-835
[235] McCluskie et al. (2002) *FEMS Immunology and Medical Microbiology* 32:179-185
[236] WO 98/40100
[237] U.S. Pat. No. 6,207,646
[238] U.S. Pat. No. 6,239,116
[239] U.S. Pat. No. 6,429,199
[240] Kandimalla et al. (2003) *Biochemical Society Transactions* 31 (part 3):654-658
[241] Blackwell et al. (2003) *J Immunol* 170:4061-4068
[242] Krieg (2002) *Trends Immunol* 23:64-65
[243] WO 01/95935
[244] Kandimalla et al. (2003) *BBRC* 306:948-953
[245] Bhagat et al. (2003) *BBRC* 300:853-861
[246] WO 03/035836
[247] WO 01/22972
[248] Schellack et al. (2006) *Vaccine* 24:5461-72
[249] Myers et al. (1990) pages 145-156 of *Cellular and molecular aspects of endotoxin reactions*
[250] Ulrich (2000) Chapter 16 (pages 273-282) of *Vaccine Adjuvants: Preparation Methods and Research Protocols* (Volume 42 of *Methods in Molecular Medicine* series). ISBN: 1-59259-083-7. Ed. O'Hagan.
[251] Johnson et al. (1999) *J Med Chem* 42:4640-9
[252] Baldrick et al. (2002) *Regulatory Toxicol Pharmacol* 35:398-413
[253] WO 94/21292
[254] U.S. Pat. No. 4,680,338
[255] U.S. Pat. No. 4,988,815
[256] WO 92/15582
[257] Stanley (2002) *Clin Exp Dermatol* 27:571-577
[258] Wu et al. (2004) *Antiviral Res.* 64(2):79-83
[259] Vasilakos et al. (2000) *Cell Immunol.* 204(1):64-74
[260] U.S. Pat. Nos. 4,689,338, 4,929,624, 5,238,944, 5,266,575, 5,268,376, 5,346,905, 5,352,784, 5,389,640, 5,395,937, 5,482,936, 5,494,916, 5,525,612, 6,083,505, 6,440,992, 6,627,640, 6,656,938, 6,660,735, 6,660,747, 6,664,260, 6,664,264, 6,664,265, 6,667,312, 6,670,372, 6,677,347, 6,677,348, 6,677,349, 6,683,088, 6,703,402, 6,743,920, 6,800,624, 6,809,203, 6,888,000 and 6,924,293
[261] Jones (2003) *Curr Opin Investig Drugs* 4:214-218
[262] WO 2004/060308
[263] WO 2004/064759
[264] U.S. Pat. No. 6,924,271
[265] US 2005/0070556
[266] U.S. Pat. No. 5,658,731
[267] U.S. Pat. No. 5,011,828
[268] WO2004/87153
[269] U.S. Pat. No. 6,605,617
[270] WO 02/18383
[271] WO 2004/018455
[272] WO 03/082272
[273] Johnson et al. (1999) *Bioorg Med Chem Lett* 9:2273-2278
[274] Evans et al. (2003) *Expert Rev Vaccines* 2:219-229
[275] Andrianov et al. (1998) *Biomaterials* 19:109-115
[276] Payne et al. (1998) *Adv Drug Delivery Review* 31:185-196
[277] WO 03/011223
[278] Meraldi et al. (2003) *Vaccine* 21:2485-2491
[279] Pajak et al. (2003) *Vaccine* 21:836-842
[280] Wong et al. (2003) *J Clin Pharmacol* 43(7):735-42
[281] US 2005/0215517
[282] WO 90/14837
[283] Podda & Del Giudice (2003) *Expert Rev Vaccines* 2:197-203
[284] Podda (2001) *Vaccine* 19: 2673-2680
[285] *Vaccine Design: The Subunit and Adjuvant Approach* (eds. Powell & Newman) Plenum Press 1995 (ISBN 0-306-44867-X)
[286] *Vaccine Adjuvants: Preparation Methods and Research Protocols* (Volume 42 of *Methods in Molecular Medicine* series). ISBN: 1-59259-083-7. Ed. O'Hagan
[287] Allison & Byars (1992) *Res Immunol* 143:519-25
[288] Hariharan et al. (1995) *Cancer Res* 55:3486-9
[289] WO 95/11700
[290] U.S. Pat. No. 6,080,725
[291] WO 2005/097181
[292] Wills et al. (2000) *Emerging Therapeutic Targets* 4:1-32
[293] *Molecular Biology Techniques: An Intensive Laboratory Course*, (Ream et al., eds., 1998, Academic Press)
[294] *Methods In Enzymology* (S. Colowick and N. Kaplan, eds., Academic Press, Inc.)
[295] *Handbook of Experimental Immunology*, Vols. I-IV (D. M. Weir and C. C. Blackwell, eds, 1986, Blackwell Scientific Publications)
[296] Sambrook et al. (2001) *Molecular Cloning: A Laboratory Manual,* 3rd edition (Cold Spring Harbor Laboratory Press)
[297] *Handbook of Surface and Colloidal Chemistry* (Birdi, K. S. ed., CRC Press, 1997)
[298] Ausubel et al. (eds) (2002) *Short protocols in molecular biology,* 5th edition (Current Protocols)
[299] *PCR (Introduction to Biotechniques Series)*, 2nd ed. (Newton & Graham eds., 1997, Springer Verlag)
[300] *Current Protocols in Molecular Biology* (F. M. Ausubel et al., eds., 1987) Supplement 30
[301] Smith & Waterman (1981) *Adv. Appl. Math.* 2: 482-489

SEQUENCE LISTING (298 sequences)

SEQ ID NO: 1 - protein, 705 aa, Streptococcus agalactiae
MKRINKYFAMFSALLLTLTSLLSVAPAFADEATTNTVTLHKILQTESNLNKSNFPGTTGLNGKDYKGGAISDLAGYFGEGSKEIEGAFFALALKEDKSGKVQYVKAKEGNKLTPALINKDGTPEITVNIDEAVSGLTPEGDTGLVFNTKGLKGEFKIVEVKSKSTYNNNGSLLAASKAVPVNITLPLVNEDGVVADAHVYPKNTEEKPEIDKNFAKTNDLTALTDVNRLLTAGANYGNYARDKATATAEIGKVVPYEVKTKIHKGSKYENLVWTDIMSNGLTMGSTVSLKASGTTETFAKDTDYELSIDARGFTLKFTADGLGKLEKAAKTADIEFTLTYSATVNGQAIIDNPESNDIKLSYGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEWITDKARAITYTSNDQGQFEVTGLADGTYNLEETLAPAGFAKLAGNIKFVVNQGSYITGGNIDYVANSNQKDATRVENKKVTIPQTGGIGTILFTIIGLSIMLGAVVIMKRRQSKEA

SEQ ID NO: 2 - protein, 675 aa, Streptococcus agalactiae
MKKINKYFAVFSALLLTVTSLFSVAPVFAEEAKTTDTVTLHKIVMPRTAFDGFTAGTKGKDNTDYVGKQIEDLKTYFGSGEAKEIAGAYFAFKNEAGTKYITENGEEVDTLDTTDAKGCAVLKGLTTDNGFKFNTSKLTGTYQIVELKEKSTYNNDGSILADSKAVPVKITLPLVNDNGVVKDAHVYPKNTETKPQVDKNFADKELDYANNKKDKGTVSASVGDVKKYHVGTKILKGSDYKKLIWTDSMTKGLTFNNDIAVTLDGATLDATNYKLVADDQGFRLVLTDKGLEAVAKAAKTKDVEIKITYSATLNGSAVVEVLETNDVKLDYGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYEWVEDKNAKNVVKLISNDKGQFEITGLTEGQYSLEETQAPTGYAKLSGDVSFNVNATSYSKGSAQDIEYTQGSKTKDAQQVINKKVTIPQTGGIGTIFFTIIGLSIMLGAVVIMKRRQSEEV

SEQ ID NO: 3 - protein, 674 aa, Streptococcus agalactiae
MKKINKCLTMFSTLLLILTSLFSVAPAFADDATTDTVTLHKIVMPQAAFDNFTEGTKGKNDSDYVGKQINDLKSYFGSTDAKEIKGAFFVFKNETGTKFITENGKEVDTLEAKDAEGGAVLSGLTKDNGFVFNTAKLKGIYQIVELKEKSNYDNNGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGEDFPVLNYKLVTDDQGFRLALNATGLAAVAAAAKDKDVEIKITYSATVNGSTTVEIPETNDVKLDYGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYGLEETQAPAGYATLSGDVNFEVTATSYSKGATTDIAYDKGSVKKDAQQVQNKKVTIPQTGGIGTILFTIIGLSIMLGAVVIMKKRQSEEA

SEQ ID NO: 4 - protein, 693 aa, Streptococcus agalactiae
MKRINKYFAMFSALLLILTSLLSVAPVFAAEMGNITKTVTLHKIVQTSDNLAKPNFPGINGLNGTKYMGQKLTDISGYFGQGSKEIAGAFFAVMNESQTKYITESGTEVESIDAAGVLKGLTTENGITFNTANLKGTYQIVELLDKSNYKNGDKVLADSKAVPVKITLPLYNEEGIVVDAEVYPKNTEEAPQIDKNFAKANKLLNDSDNSAIAGGADYDKYQAEKAKATAEIGQEIPYEVKTKIQKGSKYKNLAWVDTMSNGLTMGNTVNLEASSGSFVEGTDYNVERDDRGFTLKFTDTGLTKLQKEAETQAVEFTLTYSATVNGAAIDDKPESNDIKLQYGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEWVTNKEDANVVKVTSNADGQFEVSGLATGDYKLEETQAPAGYAKLAGDVDFKVGNSSKADDSGNIDYTASSNKKDAQRIENKKVTIPQTGGIGTILFTIIGLSIMLGAVIIMKRRQSEEA

SEQ ID NO: 5 - protein, 704 aa, Streptococcus agalactiae
MKKINKYFAVFSALLLTVTSLLSVAPAFADEATTNTVTLHKILQTESNLNKSNFPGTTGLNGDDYKGESISDLAEYFGSGSKEIDGAFFALALEEEKDGVVQYVKAKANDKLTPDLITKGTPATTTKVEEAVGGLTTGTGIVFNTAGLKGNFKIIELKDKSTYNNNGSLLAASKAVPVKITLPLVSKDGVVKDAHVYPKNTETKPEVDKNFAKTNDLTALKDATLLKAGADYKNYSATKATVTAEIGKVIPYEVKTKVLKGSKYEKLVWTDTMSNGLTMGDDVNLAVSGTTTTFIKDIDYTLSIDDRGFTLKFKATGLDKLEEAAKASDVEFTLTYKATVNGQAIIDNPEVNDIKLDYGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYTWVDEKTKAITFTSNNQGQFEVTGLEVGSYKLEETLAPAGYAKLSGDIEFTVGHDSYTSGDIKYKTDDASNNAQKVFNKKVTIPQTGGIGTILFTIIGLSIMLGAVVIMKRRQSEEA

SEQ ID NO: 6 - protein, 682 aa, Streptococcus agalactiae
MKKINKFFVAFSALLLILTSLLSVAPAFAEEERTTETVTLHKILQTETNLKNSAFPGTKGLDGTEYDGKAIDKLDSYFGNDSKDIGGAYFILANSKGEYIKANDKNKLKPEFSGNTPKTTLNISEAVGGLTEENAGIKFETTGLRGDFQIIELKDKSTYNNGGAILADSKAVPVKITLPLINKDGVVKDAHVYPKNTETKPQIDKNFADKNLDYINNQKDKGTISATVGDVKKYTVGTKILKGSDYKKLVWTDSMTKGLTFNNDVTVTLDGANFEQSNYTLVADDQGFRLVLNATGLSKVAEAAKTKDVEIKINYSATVNGSTVVEKSENNDVKLDYGNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYEWVVDKNAANVVKLISNTAGKFEITGLNAGEYSLEETQAPTGYAKLSSDVSFKVNDTSYSEGASNDIAYDKDSGKTDAQKVVNKKVTIPQTGGIGTILFTIIGLSIMLGAVVIMKRRQSEEA

SEQ ID NO: 7 - protein, 674 aa, Streptococcus agalactiae
MKKINKCLTVFSTLLLILTSLFSVAPAFADDVTTDTVTLHKIVMPQAAFDNFTEGTKGKNDSDYVGKQINDLKSYFGSTDAKEIKGAFFVFKNETGTKFITENGKEVDTLEAKDAEGGAVLSGLTKDTGFAFNTAKLKGTYQIVELKEKSNYDNNGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGKDFPVLNYKLVTDDQGFRLALNATGLAAVAAAAKDKDVEIKITYSATVNGSTTVEVPETNDVKLDYGNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYSLEETQAPAGYATLSGDVNFEVTATSYSKGATTDIAYDKGSVKKDAQQVQNKKVTIPQTGGIGTILFTIIGLSIMLGAVVVMKKRQSEEA

SEQ ID NO: 8 - protein, 146 aa, Streptococcus agalactiae
DEATTNTVTLHKILQTESNLNKSNFPGTTGLNGKDYKGGAISDLAGYFGEGSKEIEGAFFALALKEDKSGKVQYVKAKEGNKLTPALINKDGTPEITVNIDEAVSGLTPEGDTGLVFNTKGLKGEFKIVEVKSKSTYNNNGSLLAA

SEQ ID NO: 9 - protein, 201 aa, Streptococcus agalactiae
NGSLLAASKAVPVNITLPLVNEDGVVADAHVYPKNTEEKPEIDKNFAKTNDLTALTDVNRLLTAGANYGNYARDKATATAEIGKVVPYEVKTKIHKGSKYENLVWTDIMSNGLTMGSTVSLKASGTTETFAKDTDYELSIDARGFTLKFTADGLGKLEKAAKTADIEFTLTYSATVNGQAIIDNPESNDIKLSYGNKPGKD

SEQ ID NO: 10 - protein, 147 aa, Streptococcus agalactiae
GNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAG

SEQ ID NO: 11 - protein, 168 aa, Streptococcus agalactiae
QGDRLAGAQFVVKNSAGKYLALKADQSEGQKTLAAKKIALDEAIAAYNKLSATDQKGEKGITAKELIKTKQADYDAAFIEARTAYEWITDKARAITYTSNDQGQFEVTGLADGTYNLEETLAPAGFAKLAGNIKFVVNQGSYITGGNIDYVANSNQKDATRVENKKVT

SEQ ID NO: 12 - protein, 133 aa, Streptococcus agalactiae
EEAKTTDTVTLHKIVMPRTAFDGFTAGTKGKDNTDYVGKQIEDLKTYFGSGEAKEIAGAYFAFKNEAGTKYITENGEEVDTLDTTDAKGCAVLKGLTTDNGFKFNTSKLTGTYQIVELKEKSTYNNDGSILAD

SEQ ID NO: 13 - protein, 183 aa, Streptococcus agalactiae
DGSILADSKAVPVKITLPLVNDNGVVKDAHVYPKNTETKPQVDKNFADKELDYANNKKDKGTVSASVGDVKKYHVGTKILKGSDYKKLIWTDSMTKGLTFNNDIAVTLDGATLDATNYKLVADDQGFRLVLTDKGLEAVAKAAKTKDVEIKITYSATLNGSAVVEVLETNDVKLDYGNNPTIE

SEQ ID NO: 14 - protein, 168 aa, Streptococcus agalactiae
GNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKA

SEQ ID NO: 15 - protein, 169 aa, Streptococcus agalactiae
LAGATFLVKKDGKYLARKSGVATDAEKAAVDSTKSALDAAVKAYNDLTKEKQEGQDGKSALATVSEKQKAYNDAFVKANYSYEWVEDKNAKNVVKLISNDKGQFEITGLTEGQYSLEETQAPTGYAKLSGDVSFNVNATSYSKGSAQDIEYTQGSKTKDAQQVINKKVT

SEQ ID NO: 16 - protein, 133 aa, Streptococcus agalactiae
DDATTDTVTLHKIVMPQAAFDNFTEGTKGKNDSDYVGKQINDLKSYFGSTDAKEIKGAFFVFKNETGTKFITENGKEVDTLEAKDAEGGAVLSGLTKDNGFVFNTAKLKGIYQIVELKEKSNYDNNGSILADS

SEQ ID NO: 17 - protein, 183 aa, Streptococcus agalactiae
NGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGEDFPVLNYKLVTDDQGFRLALNATGLAAVAAAAKDKDVEIKITYSATVNGSTTVEIPETNDVKLDYGNNPTEE

SEQ ID NO: 18 - protein, 144 aa, Streptococcus agalactiae
GNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGA

SEQ ID NO: 19 - protein, 172 aa, Streptococcus agalactiae
TERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYGLEETQAPAGYATLSGDVNFEVTATSYSKGATTDIAYDKGSVKKDAQQVQNKKVT

SEQ ID NO: 20 - protein, 129 aa, Streptococcus agalactiae
AEMGNITKTVTLHKIVQTSDNLAKPNFPGINGLNGTKYMGQKLTDISGYFGQGSKEIAGAFFAVMNESQTKYITESGTEVESIDAAGVLKGLTTENGITFNTANLKGTYQIVELLDKSNYKNGDKVLAD

SEQ ID NO: 21 - protein, 199 aa, Streptococcus agalactiae
GDKVLADSKAVPVKITLPLYNEEGIVVDAEVYPKNTEEAPQIDKNFAKANKLLNDSDNSAIAGGADYDKYQAEKAKATAEIGQEIPYEVKTKIQKGSKYKNLAWVDTMSNGLTMGNTVNLEASSGSFVEGTDYNVERDDRGFTLKFTDTGLTKLQKEAETQAVEFTLTYSATVNGAAIDDKPESNDIKLQYGNKPGKKV

SEQ ID NO: 22 - protein, 151 aa, Streptococcus agalactiae
GNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGA

SEQ ID NO: 23 - protein, 172 aa, Streptococcus agalactiae
TERLQGAQFVVKDSAGKYLALKSSATISAQTTAYTNAKTALDAKIAAYNKLSADDQKGTKGETAKAEIKTAQDAYNAAFIVARTAYEWVTNKEDANVVKVTSNADGQFEVSGLATGDYKLEETQAPAGYAKLAGDVDFKVGNSSKADDSGNIDYTASSNKKDAQRIENKKVT

SEQ ID NO: 24 - protein, 143 aa, Streptococcus agalactiae
DEATTNTVTLHKILQTESNLNKSNFPGTTGLNGDDYKGESISDLAEYFGSGSKEIDGAFFALALEEEKDGVVQYVKAKANDKLTPDLITKGTPATTTKVEEAVGGLTTGTGIVFNTAGLKGNFKIIELKDKSTYNNNGSLLAA

SEQ ID NO: 25 - protein, 200 aa, Streptococcus agalactiae
NGSLLAASKAVPVKITLPLVSKDGVVKDAHVYPKNTETKPEVDKNFAKTNDLTALKDATLLKAGADYKNYSATKATVTAEIGKVIPYEVKTKVLKGSKYEKLVWTDTMSNGLTMGDDVNLAVSGTTTTFIKDIDYTLSIDDRGFTLKFKATGLDKLEEAAKASDVEFTLTYKATVNGQAIIDNPEVNDIKLDYGNKPGTD

SEQ ID NO: 26 - protein, 149 aa, Streptococcus agalactiae
GNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAG

SEQ ID NO: 27 - protein, 169 aa, Streptococcus agalactiae
ADARLAGAQFVVKNSAGKFLALKEDAAVSGAQTELATAKTDLDNAIKAYNGLTKAQQEGADGTSAKELINTKQSAYDAAFIKARTAYTWVDEKTKAITFTSNNQGQFEVTGLEVGSYKLEETLAPAGYAKLSGDIEFTVGHDSYTSGDIKYKTDDASNNAQKVFNKKVT

SEQ ID NO: 28 - protein, 139 aa, Streptococcus agalactiae
EEERTTETVTLHKILQTETNLKNSAFPGTKGLDGTEYDGKAIDKLDSYFGNDSKDIGGAYFILANSKGEYIKANDKNKLKPEFSGNTPKTTLNISEAVGGLTEENAGIKFETTGLRGDFQIIELKDKSTYNNGGAILAD

SEQ ID NO: 29 - protein, 183 aa, Streptococcus agalactiae
GGAILADSKAVPVKITLPLINKDGVVKDAHVYPKNTETKPQIDKNFADKNLDYINNQKDKGTISATVGDVKKYTVGTKILKGSDYKKLVWTDSMTKGLTFNNDVTVTLDGANFEQSNYTLVADDQGFRLVLNATGLSKVAEAAKTKDVEIKINYSATVNGSTVVEKSENNDVKLDYGNNPTTE

SEQ ID NO: 30 - protein, 143 aa, Streptococcus agalactiae
GNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAG

SEQ ID NO: 31 - protein, 173 aa, Streptococcus agalactiae
SERLAGATFLVKNSQSQYLARKSGVATNEAHKAVTDAKVQLDEAVKAYNKLTKEQQESQDGKAALNLIDEKQTAYNEAFAKANYSYEWVVDKNAANVVKLISNTAGKFEITGLNAGEYSLEETQAPTGYAKLSSDVSFKVNDTSYSEGASNDIAYDKDSGKTDAQKVVNKKVT

SEQ ID NO: 32 - protein, 133 aa, Streptococcus agalactiae
DDVTTDTVTLHKIVMPQAAFDNFTEGTKGKNDSDYVGKQINDLKSYFGSTDAKEIKGAFFVFKNETGTKFITENGKEVDTLEAKDAEGGAVLSGLTKDTGFAFNTAKLKGTYQIVELKEKSNYDNNGSILADS

SEQ ID NO: 33 - protein, 183 aa, Streptococcus agalactiae
NGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGKDFPVLNYKLVTDDQGFRLALNATGLAAVAAAAKDKDVEIKITYSATVNGSTTVEVPETNDVKLDYGNNPTEE

SEQ ID NO: 34 - protein, 144 aa, Streptococcus agalactiae
GNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPINPSEPKVVTYGRKFVKTNQANTERLAGA

SEQ ID NO: 35 - protein, 172 aa, Streptococcus agalactiae
TERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYSLEETQAPAGYATLSGDVNFEVTATSYSKGATTDIAYDKGSVKKDAQQVQNKKVT

SEQ ID NO: 36 - protein, 121 aa, Streptococcus agalactiae
GNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPL

SEQ ID NO: 37 - protein, 105 aa, Streptococcus agalactiae
NPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYE

SEQ ID NO: 38 - protein, 116 aa, Streptococcus agalactiae
GNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPI

SEQ ID NO: 39 - protein, 107 aa, Streptococcus agalactiae
NPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYE

SEQ ID NO: 40 - protein, 116 aa, Streptococcus agalactiae
GNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPI

SEQ ID NO: 41 - protein, 107 aa, Streptococcus agalactiae
NPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYE

SEQ ID NO: 42 - protein, 123 aa, Streptococcus agalactiae
GNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPL

SEQ ID NO: 43 - protein, 108 aa, Streptococcus agalactiae
NPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYE

SEQ ID NO: 44 - protein, 123 aa, Streptococcus agalactiae
GNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPL

SEQ ID NO: 45 - protein, 107 aa, Streptococcus agalactiae
NPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYT

SEQ ID NO: 46 - protein, 116 aa, Streptococcus agalactiae
GNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPI

SEQ ID NO: 47 - protein, 108 aa, Streptococcus agalactiae
NPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYE

SEQ ID NO: 48 - protein, 116 aa, Streptococcus agalactiae
GNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPI

SEQ ID NO: 49 - protein, 107 aa, Streptococcus agalactiae; identical to SEQ ID NO: 41

SEQ ID NO: 50 - protein, 308 aa, Streptococcus agalactiae
GNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEWITDKARAITYTSNDQGQFEVTGLADGTYNLEETLAPAGFAKLAGNIKFVVNQGSYITGGNIDYVANSNQKDATRVENKKVT

SEQ ID NO: 51 - protein, 226 aa, Streptococcus agalactiae
GNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYE

SEQ ID NO: 52 - protein, 502 aa, Streptococcus agalactiae
NGSLLAASKAVPVNITLPLVNEDGVVADAHVYPKNTEEKPEIDKNFAKTNDLTALTDVNRLLTAGANYGNYARDKATATAEIGKVVPYEVKTKIHKGSKYENLVWTDIMSNGLTMGSTVSLKASGTTETFAKDTDYELSIDARGFTLKFTADGLGKLEKAAKTADIEFTLTYSATVNGQAIIDNPESNDIKLSYGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEWITDKARAITYTSNDQGQFEVTGLADGTYNLEETLAPAGFAKLAGNIKFVVNQGSYITGGNIDYVANSNQKDATRVENKKVT

SEQ ID NO: 53 - protein, 420 aa, Streptococcus agalactiae
NGSLLAASKAVPVNITLPLVNEDGVVADAHVYPKNTEEKPEIDKNFAKTNDLTALTDVNRLLTAGANYGNYARDKATATAEIGKVVPYEVKTKIHKGSKYENLVWTDIMSNGLTMGSTVSLKASGTTETFAKDTDYELSIDARGFTLKFTADGLGKLEKAAKTADIEFTLTYSATVNGQAIIDNPESNDIKLSYGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYE

SEQ ID NO: 54 - protein, 309 aa, Streptococcus agalactiae
GNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYEWVEDKNAKNVVKLISNDKGQFEITGLTEGQYSLEETQAPTGYAKLSGDVSFNVNATSYSKGSAQDIEYTQGSKTKDAQQVINKKVT

SEQ ID NO: 55 - protein, 223 aa, Streptococcus agalactiae
GNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYE

SEQ ID NO: 56 - protein, 485 aa, Streptococcus agalactiae
DGSILADSKAVPVKITLPLVNDNGVVKDAHVYPKNTETKPQVDKNFADKELDYANNKKDKGTVSASVGDVKKYHVGTKILKGSDYKKLIWTDSMTKGLTFNNDIAVTLDGATLDATNYKLVADDQGFRLVLTDKGLEAVAKAAKTKDVEIKITYSATLNGSAVVEVLETNDVKLDYGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYEWVEDKNAKNVVKLISNDKGQFEITGLTEGQYSLEETQAPTGYAKLSGDVSFNVNATSYSKGSAQDIEYTQGSKTKDAQQVINKKVT

SEQ ID NO: 57 - protein, 399 aa, Streptococcus agalactiae
DGSILADSKAVPVKITLPLVNDNGVVKDAHVYPKNTETKPQVDKNFADKELDYANNKKDKGTVSASVGDVKKYHVGTKILKGSDYKKLIWTDSMTKGLTFNNDIAVTLDGATLDATNYKLVADDQGFRLVLTDKGLEAVAKAAKTKDVEIKITYSATLNGSAVVEVLETNDVKLDYGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYE

SEQ ID NO: 58 - protein, 309 aa, Streptococcus agalactiae
GNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYGLEETQAPAGYATLSGDVNFEVTATSYSKGATTDIAYDKGSVKKDAQQVQNKKVT

SEQ ID NO: 59 - protein, 223 aa, Streptococcus agalactiae
GNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYE

SEQ ID NO: 60 - protein, 485 aa, Streptococcus agalactiae
NGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGEDFPVLNYKLVTDDQGFRLALNATGLAAVAAAAKDKDVEIKITYSATVNGSTTVEIPETNDVKLDYGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYGLEETQAPAGYATLSGDVNFEVTATSYSKGATTDIAYDKGSVKKDAQQVQNKKVT

SEQ ID NO: 61 - protein, 399 aa, Streptococcus agalactiae
NGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGEDFPVLNYKLVTDDQGFRLALNATGLAAVAAAAKDKDVEIKITYSATVNGSTTVEIPETNDVKLDYGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYE

SEQ ID NO: 62 - protein, 316 aa, Streptococcus agalactiae
GNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEWVTNKEDANVVKVTSNADGQFEVSGLATGDYKLEETQAPAGYAKLAGDVDFKVGNSSKADDSGNIDYTASSNKKDAQRIENKKVT

SEQ ID NO: 63 - protein, 231 aa, Streptococcus agalactiae
GNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYE

SEQ ID NO: 64 - protein, 507 aa, Streptococcus agalactiae
GDKVLADSKAVPVKITLPLYNEEGIVVDAEVYPKNTEEAPQIDKNFAKANKLLNDSDNSAIAGGADYDKYQAEKAKATAEIGQEIPYEVKTKIQKGSKYKNLAWVDTMSNGLTMGNTVNLEASSGSFVEGTDYNVERDDRGFTLKFTDTGLTKLQKEAETQAVEFTLTYSATVNGAAIDDKPESNDIKLQYGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEWVTNKEDANVVKVTSNADGQFEVSGLATGDYKLEETQAPAGYAKLAGDVDFKVGNSSKADDSGNIDYTASSNKKDAQRIENKKVT

SEQ ID NO: 65 - protein, 422 aa, Streptococcus agalactiae
GDKVLADSKAVPVKITLPLYNEEGIVVDAEVYPKNTEEAPQIDKNFAKANKLLNDSDNSAIAGGADYDKYQAEKAKATAEIGQEIPYEVKTKIQKGSKYKNLAWVDTMSNGLTMGNTVNLEASSGSFVEGTDYNVERDDRGFTLKFTDTGLTKLQKEAETQAVEFTLTYSATVNGAAIDDKPESNDIKLQYGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYE

SEQ ID NO: 66 - protein, 311 aa, Streptococcus agalactiae
GNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYTWVDEKTKAITFTSNNQGQFEVTGLEVGSYKLEETLAPAGYAKLSGDIEFTVGHDSYTSGDIKYKTDDASNNAQKVFNKKVT

SEQ ID NO: 67 - protein, 230 aa, Streptococcus agalactiae
GNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYT

SEQ ID NO: 68 - protein, 504 aa, Streptococcus agalactiae
NGSLLAASKAVPVKITLPLVSKDGVVKDAHVYPKNTETKPEVDKNFAKTNDLTALKDATLLKAGADYKNYSATKATVTAEIGKVIPYEVKTKVLKGSKYEKLVWTDTMSNGLTMGDDVNLAVSGTTTTFIKDIDYTLSIDDRGFTLKFKATGLDKLEEAAKASDVEFTLTYKATVNGQAIIDNPEVNDIKLDYGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYTWVDEKTKAITFTSNNQGQFEVTGLEVGSYKLEETLAPAGYAKLSGDIEFTVGHDSYTSGDIKYKTDDASNNAQKVFNKKVT

SEQ ID NO: 69 - protein, 423 aa, Streptococcus agalactiae
NGSLLAASKAVPVKITLPLVSKDGVVKDAHVYPKNTETKPEVDKNFAKTNDLTALKDATLLKAGADYKNYSATKATVTAEIGKVIPYEVKTKVLKGSKYEKLVWTDTMSNGLTMGDDVNLAVSGTTTTFIKDIDYTLSIDDRGFTLKFKATGLDKLEEAAKASDVEFTLTYKATVNGQAIIDNPEVNDIKLDYGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYT

SEQ ID NO: 70 - protein, 310 aa, Streptococcus agalactiae
GNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYEWVVDKNAANVVKLISNTAGKFEITGLNAGEYSLEETQAPTGYAKLSSDVSFKVNDTSYSEGASNDIAYDKDSGKTDAQKVVNKKVT

SEQ ID NO: 71 - protein, 224 aa, Streptococcus agalactiae
GNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYE

SEQ ID NO: 72 - protein, 486 aa, Streptococcus agalactiae
GGAILADSKAVPVKITLPLINKDGVVKDAHVYPKNTETKPQIDKNFADKNLDYINNQKDKGTISATVGDVKKYTVGTKILKGSDYKKLVWTDSMTKGLTFNNDVTVTLDGANFEQSNYTLVADDQGFRLVLNATGLSKVAEAAKTKDVEIKINYSATVNGSTVVEKSENNDVKLDYGNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYEWVVDKNAANVVKLISNTAGKFEITGLNAGEYSLEETQAPTGYAKLSSDVSFKVNDTSYSEGASNDIAYDKDSGKTDAQKVVNKKVT

SEQ ID NO: 73 - protein, 400 aa, Streptococcus agalactiae
GGAILADSKAVPVKITLPLINKDGVVKDAHVYPKNTETKPQIDKNFADKNLDYINNQKDKGTISATVGDVKKYTVGTKILKGSDYKKLVWTDSMTKGLTFNNDVTVTLDGANFEQSNYTLVADDQGFRLVLNATGLSKVAEAAKTKDVEIKINYSATVNGSTVVEKSENNDVKLDYGNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYE

SEQ ID NO: 74 - protein, 309 aa, Streptococcus agalactiae
GNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYSLEETQAPAGYATLSGDVNFEVTATSYSKGATTDIAYDKGSVKKDAQQVQNKKVT

SEQ ID NO: 75 - protein, 223 aa, Streptococcus agalactiae
GNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYE

SEQ ID NO: 76 - protein, 485 aa, Streptococcus agalactiae
NGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGKDFPVLNYKLVTDDQGFRLALNATGLAAVAAAAKDKDVEIKITYSATVNGSTTVEVPETNDVKLDYGNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYSLEETQAPAGYATLSGDVNFEVTATSYSKGATTDIAYDKGSVKKDAQQVQNKKVT

SEQ ID NO: 77 - protein, 399 aa, Streptococcus agalactiae
NGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGKDFPVLNYKLVTDDQGFRLALNATGLAAVAAAAKDKDVEIKITYSATVNGSTTVEVPETNDVKLDYGNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYE

SEQ ID NO: 78 - protein, 26 aa, Streptococcus agalactiae
TYRVIERVSGYAPEYVSFVNGVVTIK

SEQ ID NO: 79 - protein, 6 aa, Artificial Sequence
  source: /note="Description of Artificial Sequence: Synthetic 6xHis tag"
HHHHHH

SEQ ID NO: 80 - protein, 4 aa, Artificial Sequence
  source: /note="Description of Artificial Sequence: Synthetic peptide"
GSGS

SEQ ID NO: 81 - protein, 6 aa, Artificial Sequence
  source: /note="Description of Artificial Sequence: Synthetic peptide"
GSGGGG

SEQ ID NO: 82 - protein, 8 aa, Artificial Sequence
  source: /note="Description of Artificial Sequence: Synthetic peptide"
GSGSGGGG

SEQ ID NO: 83 - protein, 736 aa, Streptococcus agalactiae
MGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPIGSGSGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLGSGSGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPIGSGSGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLGSGSGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLGSGSGNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPI

SEQ ID NO: 84 - protein, 1378 aa, Streptococcus agalactiae
MGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYEGSGSGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEGSGSGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYTGSGSGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEGSGSGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEGSGSGNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYE

SEQ ID NO: 85 - protein, 916 aa, Streptococcus agalactiae
MGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEGSGSGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYEGSGSGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEGSGSGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYE

SEQ ID NO: 86 - protein, 916 aa, Streptococcus agalactiae
MGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEGSGSGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEGSGSGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEGSGSGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYE

SEQ ID NO: 87 - protein, 1227 aa, Streptococcus agalactiae
MDGSILADSKAVPVKITLPLVNDNGVVKDAHVYPKNTETKPQVDKNFADKELDYANNKKDKGTVSASVGDVKKYHVGTKILKGSDYKKLIWTDSMTKGLTFNNDIAVTLDGATLDATNYKLVADDQGFRLVLTDKGLEAVAKAAKTKDVEIKITYSATLNGSAVVEVLETNDVKLDYGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYEGSGSNGSLLAASKAVPVNITLPLVNEDGVVADAHVYPKNTEEKPEIDKNFAKTNDLTALTDVNRLLTAGANYGNYARDKATATAEIGKVVPYEVKTKIHKGSKYENLVWTDIMSNGLTMGSTVSLKASGTTETFAKDTDYELSIDARGFTLKFTADGLGKLEKAAKTADIEFTLTYSATVNGQAIIDNPESNDIKLSYGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEGSGSNGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGEDFPVLNYKLVTDDQGFRLALNATGLAAVAAAAKDKDVEIKITYSATVNGSTTVEIPETNDVKLDYGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYE

SEQ ID NO: 88 - DNA, 2214 bp, Streptococcus agalactiae
atgggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcggatccggatccggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttggatccggatccggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcggatccggatccggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgggatccggatccggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttggatccggatccggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatctaatga

SEQ ID NO: 89 - DNA, 4140 bp, Streptococcus agalactiae
atgggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaaggatccggatccggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaaggatccggatccggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttatacaggatccggatccggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagggatccggatccggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagggatccggatccggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaataatga

SEQ ID NO: 90 - DNA, 2754 bp, Streptococcus agalactiae
atgggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagggatccggatccggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaaggatccggatccggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagggatccggatccggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaataatga

SEQ ID NO: 91 - DNA, 2754 bp, Streptococcus agalactiae
atgggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaaggatccggatccggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagggatccggatccggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagggatccggatccggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaataatga

SEQ ID NO: 92 - DNA, 3687 bp, Streptococcus agalactiae
atggatggttctatcttggctgattcaaaagcagttccagttaaaatcactcttccattggtaaacgacaatggtgttgttaaagacgctcacgtttatccaaagaacactgaaacaaaaccacaagtagataagaacttcgcagataaagaacttgattatgcgaacaacaaaaaagacaaagggactgtctcagcatctgttggtgatgttaaaaaataccatgttggaacaaaaatccttaaaggttcagactataagaaattaatctggaccgatagcatgaccaaaggtttgactttcaacaacgatattgctgtaacattggatggtgcaactcttgatgctacaaattacaaacttgtagcagatgaccaaggtttccgccttgtcttgactgacaaaggtcttgaagcagtggcaaaagccgcaaaaacaaaagatgttgaaatcaagatcacttactcagctactttgaacggttctgctgtcgttgaagttctagaaaccaatgatgttaaattggactacggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaaggatccggatccaatggttccctcctggctgcttcaaaagcggttccagttaacatcactcttccattggtaaatgaagatggtgttgttgctgatgcccatgtttatccaaagaacactgaagaaaaaccagaaattgataaaaactttgctaaaacaaacgatttgacagcattgacagatgttaatagacttttgacagctggcgcaaattatggtaattatgcacgtgacaaagcaactgctactgctgaaatcggtaaagttgttccttatgaagttaaaacaaaaattcacaaaggttctaaatacgaaaacttggtttggacagatataatgtcaaatggtttgacaatgggttcaactgttagccttaaagcttcaggaactacagaaacttttgctaaggatacagactatgaacttagcattgatgcccgtggtttcacattaaaattcacagctgatggattgggcaaattggaaaaagcagctaaaacagctgatattgaatttacattgacttatagtgctactgttaatggtcaagcaattattgataatccagaatccaatgatatcaaattgtcgtatggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagggatccggatccaacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtgaagattttcctgttttaaactacaaactcgtaacagatgaccaaggtttccgtcttgccttgaatgcaacaggtcttgcagcagtagcagcagctgcaaaagacaaagatgttgaaatcaagatcacttactcagctacggtgaacggctccactactgttgaaattccagaaaccaatgatgttaaattggactatggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaataatga

SEQ ID NO: 93 - DNA, 2225 bp, Streptococcus agalactiae
ggtaccatatgggcaataatccgaccattgaaaatgaaccgaaagaaggcattccggttgataaaaaaattaccgtgaacaaaacctgggcagttgatggtaatgaagtgaataaagccgatgaaaccgttgatgcagtttttaccctgcaggttaaagatggtgataaatgggttaatgttgatagcgcaaaagcaaccgcagcaaccagctttaaacatacctttgaaaacctggataatgccaaaacctatcgtgttattgaacgtgttagcggttatgcaccggaatatgttagctttgtgaacggcgtggtgaccattaaaaacaataaagatagcaatgaaccgaccccgattggtagcggtagcggtaataaaccgggtaaaaaagttaaagaaattccggttaccccgagcaatggtgaaattaccgtttctaaaacctgggataaaggtagcgatctggaaaatgccaatgttgtttataccctgaaagatggtggtacagcagttgcaagcgttagcctgaccaaaaccaccccgaatggcgaaattaatctgggtaatggtatcaaatttaccgttaccggtgcatttgcaggcaaatttagcggtctgaccgatagcaaaacctacatgattagcgaacgcattgcaggttatggtaataccattaccaccggtgcaggtagcgcagcaattaccaatacaccggatagcgataatccgacacctctgggttctggttctggtaataatccgacagaagaaagcgaaccgcaggaaggtacaccggcaaaccaggaaattaaagttattaaagattgggcagtggatggcaccattaccgatgcaaatgttgccgttaaagccatttttacactgcaggaaaaacagaccgacggtacatgggtgaatgttgcaagccatgaagcaaccaaaccgagccgttttgaacatacctttaccggtctggacaacgccaaaacctaccgcgtggtggaacgtgtttctggttatacccctgaatatgtgagctttaaaaacggtgttgtgaccatcaaaaataacaaaaattctaatgatccgacaccgatcggttctggttctggcaataaacctggtaaagacctgaccgaactgccggtgaccccgtctaaaggtgaagtgaccgttgcaaaaacctggtctgatggtattgcaccggatggtgttaacgtggtgtatacgctgaaagataaagataaaaccgttgccagcgtttctctgaccaaaacaagcaaaggcaccattgatctgggcaacggcatcaaatttgaagtgagcggtaattttagcggcaaattcacaggcctggaaaacaaaagttatatgatttcagaacgtgtgagtggttatggtagcgccattaatctggaaaacggcaaagtgaccattaccaataccaaagattctgataatcctacccctctgggttcaggttcaggtaataaaccaggcaccgatctgtctgaacagccggttacacctgaagatggtgaagttaaagttaccaaaacatgggcagccggtgcaaataaagcagatgcgaaagttgtgtatacactgaaaaatgcaaccaaacaggttgttgcaagcgtggcactgaccgcagcagataccaaaggtacaattaacctgggcaaaggtatgacctttgaaattaccggtgcctttagcggtacatttaaaggtctgcagaataaagcatataccgttagcgaacgtgtggcaggttataccaatgcaattaatgttaccggtaatgcagttgccattacgaatacccctgactcagataacccgacaccactgggtagtggcagcggtaacaatccgacaaccgaaaatgaacctcagaccggtaatccggtgaataaagaaattacagttcgtaaaacatgggctgtggatggcaacgaagttaataaaggtgatgaaaaagtggatgccgtgtttacgctgcaggttaaagattcagataaatgggtgaacgtggattctgcaaccgcaaccgcagccacggattttaaatatacgtttaaaaacctggataacgcgaaaacgtatcgtgttgttgaacgcgtgtctggttatgctccggcttatgtttcttttgtgggtggcgttgttacgattaaaaacaacaaaaacagtaacgatccgacgccgattctcgagctc

SEQ ID NO: 94 - DNA, 4151 bp, Streptococcus agalactiae
ggtaccatatgggcaataatccgaccattgaaaatgaaccgaaagaaggcattccggttgataaaaaaattaccgtgaacaaaacctgggcagttgatggtaatgaagtgaataaagccgatgaaaccgttgatgcagtttttaccctgcaggttaaagatggtgataaatgggttaatgttgatagcgcaaaagcaaccgcagcaaccagctttaaacatacctttgaaaacctggataatgccaaaacctatcgtgttattgaacgtgttagcggttatgcaccggaatatgttagctttgtgaacggcgtggtgaccattaaaaacaataaagatagcaatgaaccgaccccgattaatccgagcgaaccgaaagttgtgacctatggtcgcaaatttgtgaaaaccaacaaagatggtaaagaacgtctggcaggcgcaacctttctggttaaaaaagatggcaaatatctggcacgtaaaagcggtgttgcaaccgatgcagaaaaagcagcagttgatagcaccaaaagcgcactggatgcagcagttaaagcctataatgatctgaccaaagaaaaacaggaaggtcaggacggtaaatctgcactggcaaccgttagcgaaaaacagaaagcctataacgatgcctttgtgaaagcaaattatagctatgaaggtagcggtagcggtaataatccgacagaagaaagcgaaccgcaggaaggtacaccggcaaaccaggaaattaaagttattaaagattgggcagtggatggcaccattaccgatgcaaatgttgccgttaaagccatttttacactgcaggaaaaacagaccgacggtacatgggtgaatgttgcaagccatgaagcaaccaaaccgagccgttttgaacatacctttaccggtctggataacgcaaaaacatatcgcgtggtggaacgtgtttctggttatacccctgaatatgtgagctttaaaaacggtgttgtgaccatcaaaaataacaaaaactctaatgatccgacaccgatcaacccgtctgaaccgaaagtggttacgtatggccgtaaatttgttaaaacaaatcaggcaaataccgaacgcctggctggtgccacatttctggtgaaaaaagaaggtaaatatctggctcgcaaagccggtgcagcaaccgcagaagcaaaagcagccgttaaaaccgcaaaactggcactggatgaagccgtgaaagcgtataacgatctgacaaaagaaaaacaggaaggccaggaaggtaaaaccgctctggccaccgtggatcagaaacagaaagcgtataatgatgcgtttgttaaagccaactattcttatgaaggttctggttctggtaataaaccgggtacagatctgagcgaacagccggttacaccggaagatggtgaagttaaagttaccaaaacatgggcagccggtgcaaataaagcagatgccaaagttgtgtataccctgaaaaatgcaaccaaacaggttgttgcaagcgttgcactgaccgcagcagataccaaaggtacaattaacctgggcaaaggtatgacctttgaaattaccggtgcatttagcggcacctttaaaggtctgcagaataaagcatataccgtttctgaacgtgttgcaggctataccaatgcaattaatgttaccggtaatgcagttgcaattaccaatacaccggatagcgataatccgacaccgctgaatccgacccagccgaaagttgaaacccatggcaaaaaatttgttaaagttggtgatgcagatgcacgtctggctggcgcgcagtttgttgtgaaaaatagcgcaggcaaatttctggccctgaaagaagatgcagccgttagcggtgcacagaccgaactggcaaccgcaaaaaccgatctggataatgcgattaaagcatataatggcctgacaaaagcccagcaggaaggtgcagacggcaccagcgcaaaagaactgattaataccaaacagagcgcctatgatgcagcatttatcaaagcacgtaccgcatataccggtagcggttcaggcaataaacctggcaaagatctgacagaactgccggtgaccccgagcaaaggtgaagttaccgttgcaaaaacctggtctgatggtattgcaccggatggtgttaatgtggtgtatacgctgaaagataaagataaaaccgttgccagcgttagcctgaccaaaaccagcaaaggcaccattgatctgggtaatggcatcaaatttgaagtgagcggtaattttagcggcaaatttacaggcctggaaaacaaaagctatatgattagcgaacgtgttagtggctatggtagcgccattaatctggaaaatggcaaagtgaccatcaccaataccaaagattctgataacccgacccctctgaatcctacagaacctaaagtggaaacgcatggtaaaaaatttgtgaaaacaaatgaacagggtgatcgcctggccggcgctcaatttgtggttaaaaactctgccggtaaatatctggcactgaaagcagatcagagcgaaggtcagaaaaccctggcagccaaaaaaatcgccctggatgaagcaattgcagcatataacaaactgagcgccaccgatcagaaaggtgaaaaaggcattaccgccaaagaactgatcaaaacaaaacaggccgattatgatgccgcttttattgaagcccgtacagcctatgaaggttcaggtagcggcaacaaaccgggtaaaaaagttaaagaaattcctgttacaccgtctaatggtgaaattactgtgtctaaaacatgggataaaggtagcgatctggaaaacgcgaacgttgtttatacactgaaagatggtggtacagcagttgcgtctgtttctctgaccaaaacaaccccgaatggtgaaatcaatctgggcaacggtatcaaatttaccgttaccggtgctttcgctggcaaatttagcggtctgaccgattctaaaacctacatgatttccgaacgcattgcaggttatggtaataccattaccaccggtgcaggtagcgcagccattaccaatacccctgattcagacaatcctacaccactgaacccgacggaaccaaaagttgtgacacatggcaaaaaatttgtgaaaaccagcagcaccgaaaccgaacgtctgcagggtgcacagtttgttgttaaagattcagctggcaaatatctggcgctgaaaagcagcgcaaccattagcgcacagaccaccgcatatacaaatgcaaaaacagccctggatgccaaaatcgctgcctataacaaactgtctgcagatgatcagaaaggcaccaaaggtgaaaccgcaaaagcagaaatcaaaaccgcacaggatgcatataatgcagcctttattgttgcacgtaccgcgtatgaaggtagtggctctggtaacaatccgacaaccgaaaatgaacctcagaccggtaatccggtgaataaagaaattacagttcgtaaaacgtgggctgtggatggcaacgaagttaataaaggtgatgaaaaagtggatgccgtgtttacgctgcaggttaaagattcagataaatgggtgaacgttgattctgcaaccgcaaccgcagccacggattttaaatatacgtttaaaaacctggataacgcgaaaacgtatcgtgttgttgaacgcgtgtctggttatgctccggcttatgtttcttttgtgggtggcgttgttacgattaaaaacaacaaaaacagcaacgatcctactccgattaatccttcagaaccaaaagtggttacctatggccgtaaatttgtgaaaactaaccaggatggctctgaacgtctggctggtgcgacttttctggttaaaaacagccagagccagtatctggcacgcaaatctggtgttgccaccaatgaagcacataaagcagttaccgatgccaaagttcagctggatgaagcggttaaagcgtacaacaaactgacgaaagaacagcaggaatcacaggacggcaaagcagcactgaatctgattgatgaaaaacagacggcttataacgaagcgtttgccaaagcgaattattcctatgaactcgagctc

SEQ ID NO: 95 - DNA, 2765 bp, Streptococcus agalactiae
ggtaccatatgggtaataaaccgggtaaagatctgaccgaactgccggttaccccgagcaaaggtgaagttaccgttgcaaaaacctggtctgatggtattgcaccggatggtgttaatgtggtgtataccctgaaagataaagataaaaccgttgcaagcgttagcctgaccaaaaccagcaaaggcaccattgatctgggtaatggcatcaaatttgaagtgagcggtaattttagcggcaaatttaccggtctggaaaacaaaagctatatgattagcgaacgtgttagcggttatggtagcgccattaatctggaaaatggcaaagtgaccatcaccaataccaaagatagcgataatccgacaccgctgaatccgaccgaaccgaaagttgaaacccatggcaaaaaatttgttaaaaccaatgaacagggtgatcgtctggcaggcgcacagtttgttgtgaaaaatagcgcaggtaaatatctggcactgaaagcagatcagagcgaaggtcagaaaaccctggcagccaaaaaaatcgcactggatgaagcaattgcagcatataacaaactgagcgccaccgatcagaaaggtgaaaaaggcattaccgccaaagaactgatcaaaaccaaacaggccgattatgatgcagcatttattgaagcacgtaccgcctatgaaggtagcggtagcggtaataatccgaccattgaaaatgaaccgaaagaaggcattccggttgataaaaaaattaccgtgaacaaaacctgggcagttgatggtaatgaagtgaataaagccgatgaaaccgttgatgcagtttttaccctgcaggttaaagatggtgataaatgggttaatgttgatagcgcaaaagcaaccgcagcaaccagctttaaacatacctttgaaaacctggataatgccaaaacctatcgtgttattgaacgtgtttctggctatgcaccggaatatgttagctttgtgaacggcgtggtgaccattaaaaacaataaagatagcaatgaaccgaccccgattaatccgtctgaacctaaagttgtgacctatggtcgcaaatttgtgaaaacgaacaaagatggtaaagaacgtctggctggtgcaacctttctggttaaaaaagatggcaaatatctggctcgtaaaagcggtgttgcaaccgatgcagaaaaagcagcagttgatagcaccaaaagtgcactggatgcagcagttaaagcctataatgatctgaccaaagaaaaacaggaaggtcaggacggtaaaagcgcactggcaaccgttagcgaaaaacagaaagcctataacgatgcctttgtgaaagccaattatagctatgaaggttctggcagcggcaataaacctggtaaaaaagttaaagaaattccggtgaccccgtctaatggtgaaattaccgtgtctaaaacatgggataaaggtagcgatctggaaaacgccaacgttgtttatacactgaaagatggtggtacagcagttgccagcgtttctctgaccaaaacaaccccgaatggcgaaattaatctgggcaacggtatcaaatttaccgttaccggtgcatttgcaggcaaattttctggtctgaccgatagcaaaacctacatgatctctgaacgcattgcaggttatggtaataccattaccaccggtgcaggtagcgcagcaattaccaatacaccggattctgataacccgacccctctgaaccctacagaaccaaaagtggtgacgcatggtaaaaaatttgtgaaaacaagcagcaccgaaaccgaacgtctgcagggtgcccagtttgttgttaaagattctgctggcaaatatctggccctgaaaagcagcgcaaccattagcgcacagaccaccgcatataccaatgcaaaaaccgctctggatgcaaaaatcgctgcctataacaaactgtctgcagatgatcagaaaggcaccaaaggtgaaaccgcaaaagcagaaatcaaaaccgcacaggatgcatataatgcagcctttattgttgctcgcacagcgtatgaaggttcaggttctggtaataacccgaccgaagaaagcgaaccgcaggaaggtacaccggcaaaccaggaaattaaagttattaaagattgggcagtggatggcaccattaccgatgcaaatgttgccgttaaagccatttttacactgcaggaaaaacagaccgacggtacatgggtgaatgttgcaagccatgaagcaaccaaaccgagccgttttgaacatacctttacaggtctggataacgcaaaaacatatcgcgtggtggaacgtgtgtctggttatacccctgaatatgtgagctttaaaaacggtgttgtgaccatcaaaaataacaaaaactctaatgatccgacacctattaacccgagtgaaccgaaagtggttacgtatggccgtaaatttgttaaaacaaatcaggcaaataccgaacgcctggcaggagctacatttctggtcaaaaaagaaggtaaatatctggcacgcaaagccggtgcagcaaccgcagaagcaaaagcagccgttaaaaccgcaaaactggccctggatgaagccgtgaaagcgtataacgatctgacaaaagaaaaacaggaaggtcaggaaggcaaaacagccctggccaccgttgatcagaaacagaaagcgtataatgatgcgtttgttaaagcgaactattcctatgaactcgagctc

SEQ ID NO: 96 - DNA, 2765 bp, Streptococcus agalactiae
ggtaccatatgggtaataatccgaccgaagaaagcgaaccgcaggaaggtacaccggcaaaccaggaaattaaagttattaaagattgggcagttgatggtacaattaccgatgccaatgttgcagttaaagccatttttaccctgcaggaaaaacagaccgacggtacatgggttaatgttgcaagccatgaagcaaccaaaccgagccgttttgaacatacctttaccggtctggataatgcaaaaacctatcgtgttgttgaacgtgttagcggttatacaccggaatatgtgagctttaaaaacggcgtggtgaccatcaaaaataacaaaaacagcaatgatccgaccccgattaatccgagcgaaccgaaagttgtgacctatggtcgtaaatttgtgaaaaccaatcaggcaaataccgaacgtctggcaggcgcaacctttctggttaaaaaagaaggtaaatatctggcacgtaaagccggtgcagcaaccgcagaagcaaaagcagcagttaaaaccgcaaaactggcactggatgaagcagttaaagcgtataatgatctgaccaaagaaaaacaggaaggtcaggaaggcaaaaccgcactggcaaccgttgatcagaaacagaaagcctataacgatgcctttgtgaaagcaaattatagctatgaaggtagcggtagcggtaataaaccgggtaaaaaagttaaagaaattccggttaccccgagcaatggtgaaattaccgttagcaaaacctgggataaaggtagcgatctggaaaatgccaatgtggtttataccctgaaagatggtggtacagcagttgcaagcgttagcctgaccaaaaccaccccgaatggcgaaattaatctgggtaatggtatcaaatttaccgttaccggtgcatttgcaggcaaatttagcggtctgaccgattctaaaacctacatgattagcgaacgcattgcaggttatggtaataccattaccaccggtgcaggtagcgcagcaattaccaatacaccggatagcgataatccgacaccactgaacccgactgaaccgaaagtggttacccatggcaaaaaatttgttaaaacctctagcaccgaaaccgaacgcctgcagggtgcacagtttgttgttaaagatagcgcaggcaaatatctggccctgaaaagcagcgcaaccattagcgcacagaccaccgcatataccaatgcaaaaacagcactggatgccaaaattgcagcatataacaaactgagcgcagatgatcagaaaggtacaaaaggcgaaaccgcaaaagccgaaatcaaaaccgcacaggatgcatataatgcagcatttattgttgcacgtaccgcctatgaaggttctggttctggtaataaacctggcaaagatctgaccgaactgccggtgaccccgtctaaaggtgaagtgaccgtggcaaaaacctggtctgatggtattgcaccggatggtgtgaacgttgtgtatacgctgaaagataaagataaaaccgttgccagcgtttctctgaccaaaacaagcaaaggcaccattgatctgggcaacggcatcaaatttgaagtgagcggtaattttagcggcaaatttacaggcctggaaaacaaaagctatatgatttctgaacgtgtgtctggttatggtagcgccattaatctggaaaacggcaaagtgaccattaccaataccaaagattctgataaccctacccctctgaatcctacagaacctaaagttgaaacgcacggtaaaaaattcgtgaaaacaaatgaacagggtgatcgtctggctggtgcccagtttgtggtgaaaaattctgccggtaaatatctggcgctgaaagccgatcagagcgaaggtcagaaaaccctggcagccaaaaaaatcgccctggatgaagcaatcgctgcctataacaaactgtctgcaaccgatcagaaaggcgaaaaaggcattaccgccaaagaactgatcaaaaccaaacaggccgattatgatgcagcctttattgaagctcgcacagcgtatgaaggttcaggtagcggcaataatccgacaattgaaaatgaaccgaaagaaggcattccggttgataaaaaaatcaccgtgaataaaacctgggcagtggatggcaatgaagttaataaagccgatgaaaccgttgatgcagtgtttacactgcaggttaaagatggtgataaatgggtgaatgttgatagcgcaaaagcaaccgcagcaaccagctttaaacatacctttgaaaacctggataacgccaaaacatatcgcgttatcgaacgcgtttctggttatgcccctgaatatgttagctttgtgaatggtgttgtgaccattaaaaacaataaagattctaatgaaccgacacctattaacccgtctgaacctaaagtggttacgtatggtcgcaaatttgttaaaacgaacaaagatggtaaagaacgcctggctggtgcgacattcctggtcaaaaaagatggcaaatatctggctcgcaaaagcggtgttgcaaccgatgccgaaaaagcagccgttgatagcaccaaaagcgcactggatgccgctgtgaaagcctataacgatctgacaaaagaaaaacaggaaggccaggacggtaaatctgccctggccaccgttagcgaaaaacagaaagcgtataatgatgcgtttgttaaagccaactattcctatgaactcgagctc

SEQ ID NO: 97 - DNA, 3698 bp, Streptococcus agalactiae
ggtaccatatggatggtagcattctggcagatagcaaagcagttccggtgaaaattaccctgccgctggttaatgataatggtgttgtgaaagatgcccatgtgtatccgaaaaataccgaaaccaaaccgcaggttgataaaaactttgccgataaagaactggattatgccaacaacaaaaaagataaaggcaccgttagcgccagcgttggtgatgttaaaaaatatcatgtgggcaccaaaatcctgaaaggcagcgattataaaaaactgatctggaccgatagcatgaccaaaggcctgacctttaataacgatattgcagttaccctggatggtgcaaccctggatgcaaccaactataaactggttgcagatgatcagggttttcgtctggttctgaccgataaaggtctggaagcagttgcaaaagcagccaaaaccaaagatgtggaaatcaaaattacctatagcgcaaccctgaatggtagcgcagttgttgaagttctggaaaccaacgatgtgaaactggattatggcaataatccgaccattgaaaatgaaccgaaagaaggcatccctgttgataaaaaaattaccgtgaacaaaacctgggcagttgatggtaatgaagtgaataaagccgatgaaaccgttgatgcagtttttaccctgcaggttaaagatggtgataaatgggttaatgttgatagcgcaaaagcaaccgcagcaaccagctttaaacatacctttgaaaacctggataatgccaaaacctatcgtgttattgaacgtgttagcggttatgcaccggaatatgttagctttgtgaacggcgtggtgaccattaaaaacaataaagatagcaatgaaccgaccccgattaatccgagcgaaccgaaagttgtgacctatggtcgcaaatttgtgaaaaccaacaaagatggtaaagaacgtctggcaggcgcaacctttctggttaaaaaagatggcaaatatctggcacgtaaaagcggtgttgcaaccgatgcagaaaaagcagcagttgatagcaccaaaagcgcactggatgcagcagttaaagcctataatgatctgaccaaagaaaaacaggaaggtcaggacggtaaatctgcactggcaaccgttagcgaaaaacagaaagcctataacgatgcctttgtgaaagcaaattatagctatgaaggtagcggtagcaatggtagcctgctggcagcatctaaagccgtgccggttaatatcacactgccgctggtgaacgaagatggtgtggttgccgatgcacatgtttatcctaaaaacacggaagaaaaaccggaaatcgataaaaactttgcgaaaaccaatgatctgacagcactgaccgatgttaatcgtctgctgaccgcaggcgcaaattatggtaattatgcacgcgataaagcaaccgccaccgcagaaattggtaaagtggtgccgtatgaagtgaaaaccaaaattcataaaggcagcaaatatgaaaatctggtgtggaccgatattatgagcaatggtctgaccatgggtagcaccgttagcctgaaagcaagcggtacaaccgaaacctttgccaaagataccgattatgaactgagcattgatgcacgtggttttaccctgaaatttaccgcagatggtctgggcaaactggaaaaagccgcaaaaaccgcagatattgaattcaccctgacctattctgcaaccgttaatggtcaggccattattgataacccggaaagcaacgatattaaactgagctatggcaataaaccgggtaaagatctgaccgaactgccggttaccccgagcaaaggtgaagttaccgttgcaaaaacctggtctgatggtattgcaccggatggtgttaatgtggtgtataccctgaaagataaagataaaaccgttgcaagcgttagcctgaccaaaaccagcaaaggcaccattgatctgggtaatggcatcaaatttgaagtgagcggtaattttagcggcaaatttaccggtctggaaaacaaaagctatatgattagcgaacgtgtttctggttatggtagcgccattaatctggaaaatggcaaagtgaccatcaccaataccaaagatagcgataatccgacaccgctgaatccgacagaacctaaagtggaaacccatggcaaaaaatttgttaaaacaaatgaacagggtgatcgtctggctggtgcacagtttgttgtgaaaaatagcgcaggtaaatatctggccctgaaagcagatcagagcgaaggtcagaaaaccctggcagccaaaaaaatcgccctggatgaagcaattgcagcatataacaaactgagcgccaccgatcagaaaggtgaaaaaggcattaccgccaaagaactgatcaaaaccaaacaggccgattatgatgcagcatttattgaagcacgtaccgcctatgaaggttctggttctaatggttctattctggccgattcaaaagcggttcctgttaaaatcactctgcctctggttaacaatcagggcgttgttaaagatgcgcatatctatccaaaaaacacggaaacgaaacctcaggtggataaaaactttgcggataaagatctggattataccgataatcgtaaagataaaggtgttgttagcgccaccgtgggcgataaaaaagaatatattgttggtacgaaaattctgaaaggttctgattataaaaaactggtgtggacagattctatgacgaaaggtctgacgtttaacaataatgtgaaagtgaccctggatggcgaagattttccggttctgaactataaactggtgaccgatgatcagggctttcgcctggcactgaatgcaaccggtctggcagccgtggcagcagcagcaaaagataaagatgttgaaatcaaaatcacatattcagccaccgtgaatggtagcaccaccgtggaaattccagaaacgaatgatgttaaactggattatggtaacaacccgacagaagaaagcgaaccgcaggaaggtacaccggcaaaccaggaaattaaagttattaaagattgggcagtggatggcaccattaccgatgcaaatgttgccgttaaagccatttttacactgcaggaaaaacagaccgacggtacatgggtgaatgttgcaagccatgaagcaaccaaaccgagccgttttgaacatacctttacaggtctggataacgcaaaaacatatcgcgttgtggaacgtgtttcaggctatacccctgaatatgtgagctttaaaaacggtgttgtgaccatcaaaaataacaaaaactctaatgatccgacaccgatcaacccgtctgaaccaaaagtggttacgtatggccgtaaatttgttaaaaccaatcaggcaaataccgaacgcctggctggtgccacatttctggtgaaaaaagaaggtaaatatctggctcgcaaagccggtgcagcaaccgcagaagcaaaagccgcagttaaaaccgcaaaactggcactggatgaagccgtgaaagcgtataacgatctgacaaaagaaaaacaggaaggccaggaaggtaaaacagctctggccaccgtggatcagaaacagaaagcgtataatgatgcgtttgttaaagccaactattcctatgaactcgagctc

SEQ ID NO: 98 - DNA, 26 bp, Artificial Sequence
  source: /note="Description of Artificial Sequence: Synthetic IC adjuvant oligonucleotide"
  modified_base (1)..(1): Inosine
  modified_base (3)..(3): Inosine
  modified_base (5)..(5): Inosine
  modified_base (7)..(7): Inosine
  modified_base (9)..(9): Inosine
  modified_base (11)..(11): Inosine
  modified_base (13)..(13): Inosine
  modified_base (15)..(15): Inosine
  modified_base (17)..(17): Inosine
  modified_base (19)..(19): Inosine
  modified_base (21)..(21): Inosine
  modified_base (23)..(23): Inosine
  modified_base (25)..(25): Inosine
ncncncncncncncncncncncncnc

SEQ ID NO: 99 - protein, 11 aa, Artificial Sequence
  source: /note="Description of Artificial Sequence: Synthetic Polycationic peptide adjuvant"
KLKLLLLLKLK

SEQ ID NO: 100 - DNA, 2118 bp, Streptococcus agalactiae
atgaaaagaatcaacaaatattttgcaatgttctcggcattgttactgactttaacgtcattgctctcagttgcaccagcgtttgcggatgaagcaacaactaatacagtgactttgcacaagattttgcaaaccgaatcaaatcttaacaaaagtaacttcccaggaactacaggtcttaacggaaaagactacaaaggtggagctatttctgaccttgctggttactttggcgagggatctaaagaaatcgaaggtgcgttctttgctttagctttgaaagaagataaaagtggtaaagtgcaatatgttaaggcaaaagaaggtaacaaattaacaccagccttaattaataaagatggtactcctgaaataacagtaaatattgatgaggccgtgtctggattgacaccagagggagatactggacttgttttcaacaccaaaggattgaaaggcgagtttaaaattgttgaagttaaatcaaaatctacttacaacaataatggttccctcctggctgcttcaaaagcggttccagttaacatcactcttccattggtaaatgaagatggtgttgttgctgatgcccatgtttatccaaagaacactgaagaaaaaccagaaattgataaaaactttgctaaaacaaacgatttgacagcattgacagatgttaatagacttttgacagctggcgcaaattatggtaattatgcacgtgacaaagcaactgctactgctgaaatcggtaaagttgttccttatgaagttaaaacaaaaattcacaaaggttctaaatacgaaaacttggtttggacagatataatgtcaaatggtttgacaatgggttcaactgttagccttaaagcttcaggaactacagaaacttttgctaaggatacagactatgaacttagcattgatgcccgtggtttcacattaaaattcacagctgatggattgggcaaattggaaaaagcagctaaaacagctgatattgaatttacattgacttatagtgctactgttaatggtcaagcaattattgataatccagaatccaatgatatcaaattgtcgtatggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagtggataacagataaggctagagccattacctacacttcaaacgatcaaggtcaatttgaagttacaggtcttgcagacggtacttacaaccttgaagaaacacttgctccagcaggatttgctaagttggcaggtaatattaagtttgtagttaatcaagggtcatacataacaggtggtaacattgactacgttgctaacagcaaccaaaaagatgcgacacgtgtagaaaataaaaaggtaacaatcccacaaacaggtggtattggtacaattcttttcacaattattggtttaagcattatgcttggagcagtagttatcatgaaaagacgccaatcaaaggaagcttaa

SEQ ID NO: 101 - DNA, 2028 bp, Streptococcus agalactiae
atgaaaaaaatcaacaaatattttgcagtcttctcggcattgctactgaccgtaacatcattgttctcagttgcaccagtgtttgcggaagaagcaaaaactactgacacagtgaccttgcacaagattgtcatgcctcgaactgcatttgacggttttactgctggtacaaagggtaaggataatactgactacgttggtaaacaaatcgaagaccttaaaacttactttggctcaggcgaagcgaaagaaatcgcaggtgcttactttgctttcaaaaatgaagctggtactaaatacatcactgaaaatggtgaagaagttgatactttggatacaacagatgccaaaggttgtgctgttcttaaaggtttaacaacagacaatggtttcaaatttaacacttctaaattaacaggaacttaccaaatcgttgaattgaaagaaaaatctacatacaacaacgatggttctatcttggctgattcaaaagcagttccagttaaaatcactcttccattggtaaacgacaatggtgttgttaaagacgctcacgtttatccaaagaacactgaaacaaaaccacaagtagataagaacttcgcagataaagaacttgattatgcgaacaacaaaaaagacaaagggactgtctcagcatctgttggtgatgttaaaaaataccatgttggaacaaaaatccttaaaggttcagactataagaaattaatctggaccgatagcatgaccaaaggtttgactttcaacaacgatattgctgtaacattggatggtgcaactcttgatgctacaaattacaaacttgtagcagatgaccaaggtttccgccttgtcttgactgacaaaggtcttgaagcagtggcaaaagccgcaaaaacaaaagatgttgaaatcaagatcacttactcagctactttgaacggttctgctgtcgttgaagttctagaaaccaatgatgttaaattggactacggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaatgggttgaagataaaaatgctaagaatgttgttaaattgatttctaacgataaaggtcaatttgaaattactggcttgactgaaggtcaatactcattggaagaaacacaagcaccaactggttatgctaaattatcaggtgatgtttcgtttaatgttaatgctacttcatacagtaaaggttctgctcaagatattgagtatacccaaggttctaaaactaaagatgcacaacaagttatcaataagaaggttactattccacaaacaggtggtattggtacaatttttttcacaattattggattaagtattatgcttggagcggtagttatcatgaaaagacgtcaatcagaggaagtttaa

SEQ ID NO: 102 - DNA, 2025 bp, Streptococcus agalactiae
atgaaaaaaatcaacaaatgtcttacaatgttctcgacactgctattgatcttaacgtcactattctcagttgcaccagcgtttgcggacgacgcaacaactgatactgtgaccttgcacaagattgtcatgccacaagctgcatttgataactttactgaaggtacaaaaggtaagaatgatagcgattatgttggtaaacaaattaatgaccttaaatcttattttggctcaaccgatgctaaagaaatcaagggtgctttctttgttttcaaaaatgaaactggtacaaaattcattactgaaaatggtaaggaagtcgatactttggaagctaaagatgctgaaggtggtgctgttctttcagggttaacaaaagacaatggttttgtttttaacactgctaagttaaaaggaatttaccaaatcgttgaattgaaagaaaaatcaaactacgataacaacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtgaagattttcctgttttaaactacaaactcgtaacagatgaccaaggtttccgtcttgccttgaatgcaacaggtcttgcagcagtagcagcagctgcaaaagacaaagatgttgaaatcaagatcacttactcagctacggtgaacggctccactactgttgaaattccagaaaccaatgatgttaaattggactatggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatggcttggaagaaactcaagcaccagcaggttatgcgacattgtcaggtgatgtaaactttgaagtaactgccacatcatatagcaaaggggctacaactgacatcgcatatgataaaggctctgtaaaaaaagatgcccaacaagttcaaaacaaaaaagtaaccatcccacaaacaggtggtattggtacaattcttttcacaattattggtttaagcattatgcttggagcagtagttatcatgaaaaaacgtcaatcagaggaagcttaa

SEQ ID NO: 103 - DNA, 2082 bp, Streptococcus agalactiae
atgaaaagaatcaacaaatattttgcaatgttctcggcattgttattaattttaacatcgttgttatcggtagctccggtatttgctgctgagatgggaaatatcactaaaacagtaaccttacacaaaattgttcaaacatccgataatttggctaagccaaatttcccaggaataaatggattgaatggaacgaagtatatgggtcaaaaacttactgacatttcaggatattttgggcaaggttctaaagaaatcgccggtgctttctttgcggttatgaatgaaagtcagacaaaatatatcacagaaagtggtactgaagtagaaagtatcgatgcagcaggtgtccttaaaggtttgacaactgaaaacggcattacatttaatactgcaaacttaaaaggaacataccaaatcgttgagttgcttgacaaatctaattataaaaatggtgacaaagttcttgctgactcaaaagctgtcccagtgaaaatcactcttcctttgtataacgaagaaggaattgtcgtggacgctgaagtgtatccaaagaatacagaagaagcaccacaaatcgacaaaaactttgctaaagcaaataaattgttgaatgacagtgataattcagctattgcaggtggggcagactacgacaaatatcaggcagaaaaagcaaaagctactgctgaaatcggtcaagaaatcccttacgaagttaaaacaaaaatccaaaaagggtctaaatacaaaaaccttgcttgggtcgataccatgtcaaatggtttgacaatgggtaacactgttaacttagaagcatcgtcaggctcttttgtagaaggtacagattacaatgttgaacgtgatgaccgtggtttcactttgaaattcacagatacaggtttgactaagctacaaaaagaagcggaaacacaagctgttgaattcacattgacatatagcgcaacagttaacggtgcggctattgatgacaagccagaaagcaatgatatcaaacttcaatacggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagtgggtaactaataaagaagatgctaacgttgttaaagtgacttcaaacgctgacggtcaatttgaagttagcggtcttgcaactggtgattataaacttgaagaaacacaagctccagctggttacgctaaattagcaggtgatgttgatttcaaagttggaaacagctcaaaagcagacgactcaggtaacattgattacactgctagcagcaataaaaaagacgctcaacgcatagaaaacaaaaaagtgactattccacaaacaggtggtattggtacaattcttttcacaattattggtttaagcattatgcttggagcggtaattatcatgaaaagacgtcaatcagaggaagcttaa

SEQ ID NO: 104 - DNA, 2115 bp, Streptococcus agalactiae
atgaaaaaaatcaacaaatattttgcagtcttctcggccttgctactgaccgtaacatcattgctctcagttgcaccagcgtttgcggacgaagcaacaactaatacagtgactttgcacaagatcttgcaaactgaatcaaatcttaataaaagtaacttcccaggaactacaggccttaacggagatgactataaaggtgaatctatttctgaccttgctgaatactttggatcaggttctaaagaaattgacggtgctttctttgctttggctttagaagaggaaaaagatggtgtcgtacaatatgttaaggcaaaagcaaatgacaaattaacaccagacttaattactaaaggtacacctgcaacaacaacaaaagttgaagaagctgtaggtggtttgacaactggtacgggtattgttttcaatacagctggtttgaaaggtaatttcaaaattattgaattgaaagacaaatcaacttacaacaataatggttccctcttagcagcttcaaaagcagttccggtgaaaatcactcttccattggtaagcaaagatggtgttgttaaagatgcacacgtttatccaaagaacactgaaacaaaaccagaagtagacaagaacttcgctaaaacaaacgatttgacagctctcaaagacgctactcttcttaaggctggtgcagactacaaaaactattcagcgactaaagctactgtaacagctgaaatcggtaaagttatcccttacgaagttaaaacaaaagttcttaaaggttctaaatacgaaaaactggtttggaccgataccatgtcaaatggtttgacaatgggtgatgatgttaaccttgcagtttcagggactacaacaactttcattaaagatatagattacactcttagcattgatgaccgtggtttcacattgaaattcaaagctactggattggacaaattggaagaagcagctaaagcatctgatgttgaatttacattgacttataaagctactgttaatggccaagcaattattgacaacccagaagtcaatgacatcaaattggactatggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttatacatgggtagatgaaaaaactaaagctattaccttcacttcaaataatcaaggtcaatttgaagttactggtcttgaagtaggttcttacaaacttgaagaaactcttgcaccagcaggttatgctaaattgtcaggcgacattgagtttacagttggacacgattcttacacaagtggtgacatcaagtacaagacagatgatgctagcaacaatgcacaaaaagttttcaataaaaaagtaaccatcccacaaacaggtggtattggtacaattcttttcacaattattggtttaagcattatgcttggagcggtagttatcatgaaaagacgtcaatcagaggaagcttaa

SEQ ID NO: 105 - DNA, 2049 bp, Streptococcus agalactiae
atgaaaaaaatcaacaaattttttgtggcgttctcagcgttgttactgattttaacgtcattgctctcagttgcaccagcgtttgcggaagaagaaagaacaactgagactgttactttgcataaaattttacaaactgagacaaaccttaagaatagtgctttccctggtacaaaagggctagatggaactgaatatgacgggaaagctattgataaattggatagctactttggcaatgactcaaaagatattggtggggcttactttatattggcaaatagcaagggtgaatatatcaaagctaatgataaaaataaattaaagcctgagtttagtgggaacactccgaaaacgaccctcaatattagtgaagctgtaggtggtttgacagaagaaaacgcaggtattaagtttgaaaccactggtttaagaggggatttccagattattgaattgaaagacaagtcaacttacaataatggtggggccatcttggctgattcaaaagcggttccagtgaaaatcactcttccattgataaacaaggatggtgttgttaaagatgcacacgtctatccaaagaacactgaaacaaaaccgcaaattgacaagaactttgctgataaaaatcttgattatattaacaaccaaaaagacaaaggtactatatcagcaactgttggtgatgttaaaaaatatactgttgggacaaaaatccttaaaggatctgactataaaaaattagtttggaccgatagcatgacgaaaggattgacgtttaacaacgatgttactgtaacattggatggtgcaaattttgaacaatcaaattacaccttagtagctgatgaccaaggtttccgtcttgtcttgaatgcaacaggtctttctaaagtagcagaagctgcaaaaacaaaagatgttgaaatcaaaatcaactattcagctacagtaaacggttctactgtcgttgaaaagtcagaaaataatgatgtcaaactagattatggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaatgggttgtagataaaaacgctgcaaacgttgttaaattgatttctaatacagctggtaaatttgaaattacaggtttgaatgcaggcgagtatagtttggaagagactcaagcaccaacaggttatgctaaattgtcaagtgatgtatcatttaaagtaaatgatacatcgtatagcgaaggggcttcaaatgatattgcatacgataaagactccggtaaaacagatgcacaaaaagttgtcaacaaaaaagtaacaatcccacaaacaggtggtattggtacaattcttttcacaattattggtttaagcattatgcttggagcggtagttatcatgaaaagacgtcaatcagaggaagcttaa

SEQ ID NO: 106 - DNA, 2025 bp, Streptococcus agalactiae
atgaaaaaaatcaacaaatgtcttacagtgttctcgacactgctattgatcttaacgtcactattctcagttgcaccagcgtttgcggacgacgtaacaactgatactgtgaccttgcacaagattgtcatgccacaagctgcatttgataactttactgaaggtacaaaaggtaagaatgatagcgattatgttggtaaacaaattaatgaccttaaatcttattttggctcaaccgatgctaaagaaattaagggtgctttctttgttttcaaaaatgaaactggtacaaaattcattactgaaaatggtaaggaagtcgatactttggaagctaaagatgctgaaggtggtgctgttctttcagggttaacaaaagacactggttttgcttttaacactgctaagttaaaaggaacttaccaaatcgttgaattgaaagaaaaatcaaactacgataacaacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtaaagattttcctgttttaaactacaaactcgtaacagatgaccaaggtttccgtcttgccttgaatgcaacaggtcttgcagcagtagcagctgctgcaaaagacaaagatgttgaaatcaagatcacttactcagctacggtgaacggctccactactgttgaagttccagaaaccaatgatgttaaattggactatggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatagcttggaagaaactcaagcaccagcaggttatgcgacattgtcaggtgatgtaaactttgaagtaactgccacatcatatagcaaaggggctacaactgacatcgcatatgataaaggatctgtaaaaaaagatgcccaacaagttcaaaacaaaaaagtaaccatcccacaaacaggtggtattggtacaattcttttcacaattattggtttaagcattatgcttggagcagtagttgtcatgaaaaaacgtcaatcagaggaagcttaa

SEQ ID NO: 107 - DNA, 438 bp, Streptococcus agalactiae
gatgaagcaacaactaatacagtgactttgcacaagattttgcaaaccgaatcaaatcttaacaaaagtaacttcccaggaactacaggtcttaacggaaaagactacaaaggtggagctatttctgaccttgctggttactttggcgagggatctaaagaaatcgaaggtgcgttctttgctttagctttgaaagaagataaaagtggtaaagtgcaatatgttaaggcaaaagaaggtaacaaattaacaccagccttaattaataaagatggtactcctgaaataacagtaaatattgatgaggccgtgtctggattgacaccagagggagatactggacttgttttcaacaccaaaggattgaaaggcgagtttaaaattgttgaagttaaatcaaaatctacttacaacaataatggttccctcctggctgct

SEQ ID NO: 108 - DNA, 603 bp, Streptococcus agalactiae
aatggttccctcctggctgcttcaaaagcggttccagttaacatcactcttccattggtaaatgaagatggtgttgttgctgatgcccatgtttatccaaagaacactgaagaaaaaccagaaattgataaaaactttgctaaaacaaacgatttgacagcattgacagatgttaatagacttttgacagctggcgcaaattatggtaattatgcacgtgacaaagcaactgctactgctgaaatcggtaaagttgttccttatgaagttaaaacaaaaattcacaaaggttctaaatacgaaaacttggtttggacagatataatgtcaaatggtttgacaatgggttcaactgttagccttaaagcttcaggaactacagaaacttttgctaaggatacagactatgaacttagcattgatgcccgtggtttcacattaaaattcacagctgatggattgggcaaattggaaaaagcagctaaaacagctgatattgaatttacattgacttatagtgctactgttaatggtcaagcaattattgataatccagaatccaatgatatcaaattgtcgtatggtaacaaaccaggtaaagac

SEQ ID NO: 109 - DNA, 441 bp, Streptococcus agalactiae
ggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggt

SEQ ID NO: 110 - DNA, 504 bp, Streptococcus agalactiae
caaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagtggataacagataaggctagagccattacctacacttcaaacgatcaaggtcaatttgaagttacaggtcttgcagacggtacttacaaccttgaagaaacacttgctccagcaggatttgctaagttggcaggtaatattaagtttgtagttaatcaagggtcatacataacaggtggtaacattgactacgttgctaacagcaaccaaaaagatgcgacacgtgtagaaaataaaaaggtaaca

SEQ ID NO: 111 - DNA, 399 bp, Streptococcus agalactiae
gaagaagcaaaaactactgacacagtgaccttgcacaagattgtcatgcctcgaactgcatttgacggttttactgctggtacaaagggtaaggataatactgactacgttggtaaacaaatcgaagaccttaaaacttactttggctcaggcgaagcgaaagaaatcgcaggtgcttactttgctttcaaaaatgaagctggtactaaatacatcactgaaaatggtgaagaagttgatactttggatacaacagatgccaaaggttgtgctgttcttaaaggtttaacaacagacaatggtttcaaatttaacacttctaaattaacaggaacttaccaaatcgttgaattgaaagaaaaatctacatacaacaacgatggttctatcttggctgat

SEQ ID NO: 112 - DNA, 549 bp, Streptococcus agalactiae
gatggttctatcttggctgattcaaaagcagttccagttaaaatcactcttccattggtaaacgacaatggtgttgttaaagacgctcacgtttatccaaagaacactgaaacaaaaccacaagtagataagaacttcgcagataaagaacttgattatgcgaacaacaaaaaagacaaagggactgtctcagcatctgttggtgatgttaaaaaataccatgttggaacaaaaatccttaaaggttcagactataagaaattaatctggaccgatagcatgaccaaaggtttgactttcaacaacgatattgctgtaacattggatggtgcaactcttgatgctacaaattacaaacttgtagcagatgaccaaggtttccgccttgtcttgactgacaaaggtcttgaagcagtggcaaaagccgcaaaaacaaaagatgttgaaatcaagatcacttactcagctactttgaacggttctgctgtcgttgaagttctagaaaccaatgatgttaaattggactacggcaacaacccaacaattgaa

SEQ ID NO: 113 - DNA, 504 bp, Streptococcus agalactiae
ggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagct

SEQ ID NO: 114 - DNA, 507 bp, Streptococcus agalactiae
ttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaatgggttgaagataaaaatgctaagaatgttgttaaattgatttctaacgataaaggtcaatttgaaattactggcttgactgaaggtcaatactcattggaagaaacacaagcaccaactggttatgctaaattatcaggtgatgtttcgtttaatgttaatgctacttcatacagtaaaggttctgctcaagatattgagtatacccaaggttctaaaactaaagatgcacaacaagttatcaataagaaggttact

SEQ ID NO: 115 - DNA, 399 bp, Streptococcus agalactiae
gacgacgcaacaactgatactgtgaccttgcacaagattgtcatgccacaagctgcatttgataactttactgaaggtacaaaaggtaagaatgatagcgattatgttggtaaacaaattaatgaccttaaatcttattttggctcaaccgatgctaaagaaatcaagggtgctttctttgttttcaaaaatgaaactggtacaaaattcattactgaaaatggtaaggaagtcgatactttggaagctaaagatgctgaaggtggtgctgttctttcagggttaacaaaagacaatggttttgtttttaacactgctaagttaaaaggaatttaccaaatcgttgaattgaaagaaaaatcaaactacgataacaacggttctatcttggctgattca

SEQ ID NO: 116 - DNA, 549 bp, Streptococcus agalactiae
aacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtgaagattttcctgttttaaactacaaactcgtaacagatgaccaaggtttccgtcttgccttgaatgcaacaggtcttgcagcagtagcagcagctgcaaaagacaaagatgttgaaatcaagatcacttactcagctacggtgaacggctccactactgttgaaattccagaaaccaatgatgttaaattggactatggtaataacccaacggaagaa

SEQ ID NO: 117 - DNA, 432 bp, Streptococcus agalactiae
ggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagct

SEQ ID NO: 118 - DNA, 516 bp, Streptococcus agalactiae
actgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatggcttggaagaaactcaagcaccagcaggttatgcgacattgtcaggtgatgtaaactttgaagtaactgccacatcatatagcaaaggggctacaactgacatcgcatatgataaaggctctgtaaaaaaagatgcccaacaagttcaaaacaaaaaagtaacc

SEQ ID NO: 119 - DNA, 387 bp, Streptococcus agalactiae
gctgagatgggaaatatcactaaaacagtaaccttacacaaaattgttcaaacatccgataatttggctaagccaaatttcccaggaataaatggattgaatggaacgaagtatatgggtcaaaaacttactgacatttcaggatattttgggcaaggttctaaagaaatcgccggtgctttctttgcggttatgaatgaaagtcagacaaaatatatcacagaaagtggtactgaagtagaaagtatcgatgcagcaggtgtccttaaaggtttgacaactgaaaacggcattacatttaatactgcaaacttaaaaggaacataccaaatcgttgagttgcttgacaaatctaattataaaaatggtgacaaagttcttgctgac

SEQ ID NO: 120 - DNA, 597 bp, Streptococcus agalactiae
ggtgacaaagttcttgctgactcaaaagctgtcccagtgaaaatcactcttcctttgtataacgaagaaggaattgtcgtggacgctgaagtgtatccaaagaatacagaagaagcaccacaaatcgacaaaaactttgctaaagcaaataaattgttgaatgacagtgataattcagctattgcaggtggggcagactacgacaaatatcaggcagaaaaagcaaaagctactgctgaaatcggtcaagaaatcccttacgaagttaaaacaaaaatccaaaaagggtctaaatacaaaaaccttgcttgggtcgataccatgtcaaatggtttgacaatgggtaacactgttaacttagaagcatcgtcaggctcttttgtagaaggtacagattacaatgttgaacgtgatgaccgtggtttcactttgaaattcacagatacaggtttgactaagctacaaaaagaagcggaaacacaagctgttgaattcacattgacatatagcgcaacagttaacggtgcggctattgatgacaagccagaaagcaatgatatcaaacttcaatacggtaacaaaccaggtaaaaaagta

SEQ ID NO: 121 - DNA, 453 bp, Streptococcus agalactiae
ggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgca

SEQ ID NO: 122 - DNA, 516 bp, Streptococcus agalactiae
acagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagtgggtaactaataaagaagatgctaacgttgttaaagtgacttcaaacgctgacggtcaatttgaagttagcggtcttgcaactggtgattataaacttgaagaaacacaagctccagctggttacgctaaattagcaggtgatgttgatttcaaagttggaaacagctcaaaagcagacgactcaggtaacattgattacactgctagcagcaataaaaaagacgctcaacgcatagaaaacaaaaaagtgact

SEQ ID NO: 123 - DNA, 429 bp, Streptococcus agalactiae
gacgaagcaacaactaatacagtgactttgcacaagatcttgcaaactgaatcaaatcttaataaaagtaacttcccaggaactacaggccttaacggagatgactataaaggtgaatctatttctgaccttgctgaatactttggatcaggttctaaagaaattgacggtgctttctttgctttggctttagaagaggaaaaagatggtgtcgtacaatatgttaaggcaaaagcaaatgacaaattaacaccagacttaattactaaaggtacacctgcaacaacaacaaaagttgaagaagctgtaggtggtttgacaactggtacgggtattgttttcaatacagctggtttgaaaggtaatttcaaaattattgaattgaaagacaaatcaacttacaacaataatggttccctcttagcagct

SEQ ID NO: 124 - DNA, 600 bp, Streptococcus agalactiae
aatggttccctcttagcagcttcaaaagcagttccggtgaaaatcactcttccattggtaagcaaagatggtgttgttaaagatgcacacgtttatccaaagaacactgaaacaaaaccagaagtagacaagaacttcgctaaaacaaacgatttgacagctctcaaagacgctactcttcttaaggctggtgcagactacaaaaactattcagcgactaaagctactgtaacagctgaaatcggtaaagttatcccttacgaagttaaaacaaaagttcttaaaggttctaaatacgaaaaactggtttggaccgataccatgtcaaatggtttgacaatgggtgatgatgttaaccttgcagtttcagggactacaacaactttcattaaagatatagattacactcttagcattgatgaccgtggtttcacattgaaattcaaagctactggattggacaaattggaagaagcagctaaagcatctgatgttgaatttacattgacttataaagctactgttaatggccaagcaattattgacaacccagaagtcaatgacatcaaattggactatggtaataaacctggtacagat

SEQ ID NO: 125 - DNA, 447 bp, Streptococcus agalactiae
ggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggt

SEQ ID NO: 126 - DNA, 507 bp, Streptococcus agalactiae
gcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttatacatgggtagatgaaaaaactaaagctattaccttcacttcaaataatcaaggtcaatttgaagttactggtcttgaagtaggttcttacaaacttgaagaaactcttgcaccagcaggttatgctaaattgtcaggcgacattgagtttacagttggacacgattcttacacaagtggtgacatcaagtacaagacagatgatgctagcaacaatgcacaaaaagttttcaataaaaaagtaacc

SEQ ID NO: 127 - DNA, 417 bp, Streptococcus agalactiae
gaagaagaaagaacaactgagactgttactttgcataaaattttacaaactgagacaaaccttaagaatagtgctttccctggtacaaaagggctagatggaactgaatatgacgggaaagctattgataaattggatagctactttggcaatgactcaaaagatattggtggggcttactttatattggcaaatagcaagggtgaatatatcaaagctaatgataaaaataaattaaagcctgagtttagtgggaacactccgaaaacgaccctcaatattagtgaagctgtaggtggtttgacagaagaaaacgcaggtattaagtttgaaaccactggtttaagaggggatttccagattattgaattgaaagacaagtcaacttacaataatggtggggccatcttggctgat

SEQ ID NO: 128 - DNA, 549 bp, Streptococcus agalactiae
ggtggggccatcttggctgattcaaaagcggttccagtgaaaatcactcttccattgataaacaaggatggtgttgttaaagatgcacacgtctatccaaagaacactgaaacaaaaccgcaaattgacaagaactttgctgataaaaatcttgattatattaacaaccaaaaagacaaaggtactatatcagcaactgttggtgatgttaaaaaatatactgttgggacaaaaatccttaaaggatctgactataaaaaattagtttggaccgatagcatgacgaaaggattgacgtttaacaacgatgttactgtaacattggatggtgcaaattttgaacaatcaaattacaccttagtagctgatgaccaaggtttccgtcttgtcttgaatgcaacaggtctttctaaagtagcagaagctgcaaaaacaaaagatgttgaaatcaaaatcaactattcagctacagtaaacggttctactgtcgttgaaaagtcagaaaataatgatgtcaaactagattatggtaacaacccaacaactgaa

SEQ ID NO: 129 - DNA, 429 bp, Streptococcus agalactiae
ggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcagga

SEQ ID NO: 130 - DNA, 519 bp, Streptococcus agalactiae
tctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaatgggttgtagataaaaacgctgcaaacgttgttaaattgatttctaatacagctggtaaatttgaaattacaggtttgaatgcaggcgagtatagtttggaagagactcaagcaccaacaggttatgctaaattgtcaagtgatgtatcatttaaagtaaatgatacatcgtatagcgaaggggcttcaaatgatattgcatacgataaagactccggtaaaacagatgcacaaaaagttgtcaacaaaaaagtaaca

SEQ ID NO: 131 - DNA, 399 bp, Streptococcus agalactiae
gacgacgtaacaactgatactgtgaccttgcacaagattgtcatgccacaagctgcatttgataactttactgaaggtacaaaaggtaagaatgatagcgattatgttggtaaacaaattaatgaccttaaatcttattttggctcaaccgatgctaaagaaattaagggtgctttctttgttttcaaaaatgaaactggtacaaaattcattactgaaaatggtaaggaagtcgatactttggaagctaaagatgctgaaggtggtgctgttctttcagggttaacaaaagacactggttttgcttttaacactgctaagttaaaaggaacttaccaaatcgttgaattgaaagaaaaatcaaactacgataacaacggttctatcttggctgattca

SEQ ID NO: 132 - DNA, 549 bp, Streptococcus agalactiae
aacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtaaagattttcctgttttaaactacaaactcgtaacagatgaccaaggtttccgtcttgccttgaatgcaacaggtcttgcagcagtagcagctgctgcaaaagacaaagatgttgaaatcaagatcacttactcagctacggtgaacggctccactactgttgaagttccagaaaccaatgatgttaaattggactatggtaataacccaacggaagaa

SEQ ID NO: 133 - DNA, 432 bp, Streptococcus agalactiae
ggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagct

SEQ ID NO: 134 - DNA, 516 bp, Streptococcus agalactiae
actgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatagcttggaagaaactcaagcaccagcaggttatgcgacattgtcaggtgatgtaaactttgaagtaactgccacatcatatagcaaaggggctacaactgacatcgcatatgataaaggatctgtaaaaaaagatgcccaacaagttcaaaacaaaaaagtaacc

SEQ ID NO: 135 - DNA, 363 bp, Streptococcus agalactiae
ggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattg

SEQ ID NO: 136 - DNA, 315 bp, Streptococcus agalactiae
aacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgag

SEQ ID NO: 137 - DNA, 348 bp, Streptococcus agalactiae
ggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatc

SEQ ID NO: 138 - DNA, 321 bp, Streptococcus agalactiae
aacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaa

SEQ ID NO: 139 - DNA, 348 bp, Streptococcus agalactiae
ggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatc

SEQ ID NO: 140 - DNA, 321 bp, Streptococcus agalactiae
aacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaa

SEQ ID NO: 141 - DNA, 369 bp, Streptococcus agalactiae
ggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccactt

SEQ ID NO: 142 - DNA, 321 bp, Streptococcus agalactiae
aatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttac

SEQ ID NO: 143 - DNA, 369 bp, Streptococcus agalactiae
ggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccactt

SEQ ID NO: 144 - DNA, 321 bp, Streptococcus agalactiae
aacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttataca

SEQ ID NO: 145 - DNA, 348 bp, Streptococcus agalactiae
ggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatc

SEQ ID NO: 146 - DNA, 324 bp, Streptococcus agalactiae
aatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaa

SEQ ID NO: 147 - DNA, 348 bp, Streptococcus agalactiae
ggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatc

SEQ ID NO: 148 - DNA, 321 bp, Streptococcus agalactiae
aacccatcagaaccaaaagtggtgacttatggacgtaaatttgtgaaaacaaatcaagctaacactgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaa

SEQ ID NO: 149 - DNA, 924 bp, Streptococcus agalactiae
ggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagtggataacagataaggctagagccattacctacacttcaaacgatcaaggtcaatttgaagttacaggtcttgcagacggtacttacaaccttgaagaaacacttgctccagcaggatttgctaagttggcaggtaatattaagtttgtagttaatcaagggtcatacataacaggtggtaacattgactacgttgctaacagcaaccaaaaagatgcgacacgtgtagaaaataaaaaggtaaca

SEQ ID NO: 150 - DNA, 678 bp, Streptococcus agalactiae
ggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgag

SEQ ID NO: 151 - DNA, 1506 bp, Streptococcus agalactiae
aatggttccctcctggctgcttcaaaagcggttccagttaacatcactcttccattggtaaatgaagatggtgttgttgctgatgcccatgtttatccaaagaacactgaagaaaaaccagaaattgataaaaactttgctaaaacaaacgatttgacagcattgacagatgttaatagacttttgacagctggcgcaaattatggtaattatgcacgtgacaaagcaactgctactgctgaaatcggtaaagttgttccttatgaagttaaaacaaaaattcacaaaggttctaaatacgaaaacttggtttggacagatataatgtcaaatggtttgacaatgggttcaactgttagccttaaagcttcaggaactacagaaacttttgctaaggatacagactatgaacttagcattgatgcccgtggtttcacattaaaattcacagctgatggattgggcaaattggaaaaagcagctaaaacagctgatattgaatttacattgacttatagtgctactgttaatggtcaagcaattattgataatccagaatccaatgatatcaaattgtcgtatggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagtggataacagataaggctagagccattacctacacttcaaacgatcaaggtcaatttgaagttacaggtcttgcagacggtacttacaaccttgaagaaacacttgctccagcaggatttgctaagttggcaggtaatattaagtttgtagttaatcaagggtcatacataacaggtggtaacattgactacgttgctaacagcaaccaaaaagatgcgacacgtgtagaaaataaaaaggtaaca

SEQ ID NO: 152 - DNA, 1260 bp, Streptococcus agalactiae
aatggttccctcctggctgcttcaaaagcggttccagttaacatcactcttccattggtaaatgaagatggtgttgttgctgatgcccatgtttatccaaagaacactgaagaaaaaccagaaattgataaaaactttgctaaaacaaacgatttgacagcattgacagatgttaatagacttttgacagctggcgcaaattatggtaattatgcacgtgacaaagcaactgctactgctgaaatcggtaaagttgttccttatgaagttaaaacaaaaattcacaaaggttctaaatacgaaaacttggtttggacagatataatgtcaaatggtttgacaatgggttcaactgttagccttaaagcttcaggaactacagaaacttttgctaaggatacagactatgaacttagcattgatgcccgtggtttcacattaaaattcacagctgatggattgggcaaattggaaaaagcagctaaaacagctgatattgaatttacattgacttatagtgctactgttaatggtcaagcaattattgataatccagaatccaatgatatcaaattgtcgtatggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgag

SEQ ID NO: 153 - DNA, 927 bp, Streptococcus agalactiae
ggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaatgggttgaagataaaaatgctaagaatgttgttaaattgatttctaacgataaaggtcaatttgaaattactggcttgactgaaggtcaatactcattggaagaaacacaagcaccaactggttatgctaaattatcaggtgatgtttcgtttaatgttaatgctacttcatacagtaaaggttctgctcaagatattgagtatacccaaggttctaaaactaaagatgcacaacaagttatcaataagaaggttact

SEQ ID NO: 154 - DNA, 669 bp, Streptococcus agalactiae
ggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaa

SEQ ID NO: 155 - DNA, 1455 bp, Streptococcus agalactiae
gatggttctatcttggctgattcaaaagcagttccagttaaaatcactcttccattggtaaacgacaatggtgttgttaaagacgctcacgtttatccaaagaacactgaaacaaaaccacaagtagataagaacttcgcagataaagaacttgattatgcgaacaacaaaaaagacaaagggactgtctcagcatctgttggtgatgttaaaaaataccatgttggaacaaaaatccttaaaggttcagactataagaaattaatctggaccgatagcatgaccaaaggtttgactttcaacaacgatattgctgtaacattggatggtgcaactcttgatgctacaaattacaaacttgtagcagatgaccaaggtttccgccttgtcttgactgacaaaggtcttgaagcagtggcaaaagccgcaaaaacaaaagatgttgaaatcaagatcacttactcagctactttgaacggttctgctgtcgttgaagttctagaaaccaatgatgttaaattggactacggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaatgggttgaagataaaaatgctaagaatgttgttaaattgatttctaacgataaaggtcaatttgaaattactggcttgactgaaggtcaatactcattggaagaaacacaagcaccaactggttatgctaaattatcaggtgatgtttcgtttaatgttaatgctacttcatacagtaaaggttctgctcaagatattgagtatacccaaggttctaaaactaaagatgcacaacaagttatcaataagaaggttact

SEQ ID NO: 156 - DNA, 1197 bp, Streptococcus agalactiae
gatggttctatcttggctgattcaaaagcagttccagttaaaatcactcttccattggtaaacgacaatggtgttgttaaagacgctcacgtttatccaaagaacactgaaacaaaaccacaagtagataagaacttcgcagataaagaacttgattatgcgaacaacaaaaaagacaaagggactgtctcagcatctgttggtgatgttaaaaaataccatgttggaacaaaaatccttaaaggttcagactataagaaattaatctggaccgatagcatgaccaaaggtttgactttcaacaacgatattgctgtaacattggatggtgcaactcttgatgctacaaattacaaacttgtagcagatgaccaaggtttccgccttgtcttgactgacaaaggtcttgaagcagtggcaaaagccgcaaaaacaaaagatgttgaaatcaagatcacttactcagctactttgaacggttctgctgtcgttgaagttctagaaaccaatgatgttaaattggactacggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaa

SEQ ID NO: 157 - DNA, 927 bp, Streptococcus agalactiae
ggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatggcttggaagaaactcaagcaccagcaggttatgcgacattgtcaggtgatgtaaactttgaagtaactgccacatcatatagcaaaggggctacaactgacatcgcatatgataaaggctctgtaaaaaaagatgcccaacaagttcaaaacaaaaaagtaacc

SEQ ID NO: 158 - DNA, 669 bp, Streptococcus agalactiae
ggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaa

SEQ ID NO: 159 - DNA, 1455 bp, Streptococcus agalactiae
aacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtgaagattttcctgttttaaactacaaactcgtaacagatgaccaaggtttccgtcttgccttgaatgcaacaggtcttgcagcagtagcagcagctgcaaaagacaaagatgttgaaatcaagatcacttactcagctacggtgaacggctccactactgttgaaattccagaaaccaatgatgttaaattggactatggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatggcttggaagaaactcaagcaccagcaggttatgcgacattgtcaggtgatgtaaactttgaagtaactgccacatcatatagcaaaggggctacaactgacatcgcatatgataaaggctctgtaaaaaaagatgcccaacaagttcaaaacaaaaaagtaacc

SEQ ID NO: 160 - DNA, 1197 bp, Streptococcus agalactiae
aacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtgaagattttcctgttttaaactacaaactcgtaacagatgaccaaggtttccgtcttgccttgaatgcaacaggtcttgcagcagtagcagcagctgcaaaagacaaagatgttgaaatcaagatcacttactcagctacggtgaacggctccactactgttgaaattccagaaaccaatgatgttaaattggactatggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaa

SEQ ID NO: 161 - DNA, 948 bp, Streptococcus agalactiae
ggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagtgggtaactaataaagaagatgctaacgttgttaaagtgacttcaaacgctgacggtcaatttgaagttagcggtcttgcaactggtgattataaacttgaagaaacacaagctccagctggttacgctaaattagcaggtgatgttgatttcaaagttggaaacagctcaaaagcagacgactcaggtaacattgattacactgctagcagcaataaaaaagacgctcaacgcatagaaaacaaaaaagtgact

SEQ ID NO: 162 - DNA, 693 bp, Streptococcus agalactiae
ggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgag

SEQ ID NO: 163 - DNA, 1521 bp, Streptococcus agalactiae
ggtgacaaagttcttgctgactcaaaagctgtcccagtgaaaatcactcttcctttgtataacgaagaaggaattgtcgtggacgctgaagtgtatccaaagaatacagaagaagcaccacaaatcgacaaaaactttgctaaagcaaataaattgttgaatgacagtgataattcagctattgcaggtggggcagactacgacaaatatcaggcagaaaaagcaaaagctactgctgaaatcggtcaagaaatcccttacgaagttaaaacaaaaatccaaaaagggtctaaatacaaaaaccttgcttgggtcgataccatgtcaaatggtttgacaatgggtaacactgttaacttagaagcatcgtcaggctcttttgtagaaggtacagattacaatgttgaacgtgatgaccgtggtttcactttgaaattcacagatacaggtttgactaagctacaaaaagaagcggaaacacaagctgttgaattcacattgacatatagcgcaacagttaacggtgcggctattgatgacaagccagaaagcaatgatatcaaacttcaatacggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagtgggtaactaataaagaagatgctaacgttgttaaagtgacttcaaacgctgacggtcaatttgaagttagcggtcttgcaactggtgattataaacttgaagaaacacaagctccagctggttacgctaaattagcaggtgatgttgatttcaaagttggaaacagctcaaaagcagacgactcaggtaacattgattacactgctagcagcaataaaaaagacgctcaacgcatagaaaacaaaaaagtgact

SEQ ID NO: 164 - DNA, 1263 bp, Streptococcus agalactiae
ggtgacaaagttcttgctgactcaaaagctgtcccagtgaaaatcactcttcctttgtataacgaagaaggaattgtcgtggacgctgaagtgtatccaaagaatacagaagaagcaccacaaatcgacaaaaactttgctaaagcaaataaattgttgaatgacagtgataattcagctattgcaggtggggcagactacgacaaatatcaggcagaaaaagcaaaagctactgctgaaatcggtcaagaaatcccttacgaagttaaaacaaaaatccaaaaagggtctaaatacaaaaaccttgcttgggtcgataccatgtcaaatggtttgacaatgggtaacactgttaacttagaagcatcgtcaggctcttttgtagaaggtacagattacaatgttgaacgtgatgaccgtggtttcactttgaaattcacagatacaggtttgactaagctacaaaaagaagcggaaacacaagctgttgaattcacattgacatatagcgcaacagttaacggtgcggctattgatgacaagccagaaagcaatgatatcaaacttcaatacggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttac

SEQ ID NO: 165 - DNA, 933 bp, Streptococcus agalactiae
ggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttatacatgggtagatgaaaaaactaaagctattaccttcacttcaaataatcaaggtcaatttgaagttactggtcttgaagtaggttcttacaaacttgaagaaactcttgcaccagcaggttatgctaaattgtcaggcgacattgagtttacagttggacacgattcttacacaagtggtgacatcaagtacaagacagatgatgctagcaacaatgcacaaaaagttttcaataaaaaagtaacc

SEQ ID NO: 166 - DNA, 690 bp, Streptococcus agalactiae
ggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttataca

SEQ ID NO: 167 - DNA, 1512 bp, Streptococcus agalactiae
aatggttccctcttagcagcttcaaaagcagttccggtgaaaatcactcttccattggtaagcaaagatggtgttgttaaagatgcacacgtttatccaaagaacactgaaacaaaaccagaagtagacaagaacttcgctaaaacaaacgatttgacagctctcaaagacgctactcttcttaaggctggtgcagactacaaaaactattcagcgactaaagctactgtaacagctgaaatcggtaaagttatcccttacgaagttaaaacaaaagttcttaaaggttctaaatacgaaaaactggtttggaccgataccatgtcaaatggtttgacaatgggtgatgatgttaaccttgcagtttcagggactacaacaactttcattaaagatatagattacactcttagcattgatgaccgtggtttcacattgaaattcaaagctactggattggacaaattggaagaagcagctaaagcatctgatgttgaatttacattgacttataaagctactgttaatggccaagcaattattgacaacccagaagtcaatgacatcaaattggactatggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttatacatgggtagatgaaaaaactaaagctattaccttcacttcaaataatcaaggtcaatttgaagttactggtcttgaagtaggttcttacaaacttgaagaaactcttgcaccagcaggttatgctaaattgtcaggcgacattgagtttacagttggacacgattcttacacaagtggtgacatcaagtacaagacagatgatgctagcaacaatgcacaaaaagttttcaataaaaaagtaacc

SEQ ID NO: 168 - DNA, 1269 bp, Streptococcus agalactiae
aatggttccctcttagcagcttcaaaagcagttccggtgaaaatcactcttccattggtaagcaaagatggtgttgttaaagatgcacacgtttatccaaagaacactgaaacaaaaccagaagtagacaagaacttcgctaaaacaaacgatttgacagctctcaaagacgctactcttcttaaggctggtgcagactacaaaaactattcagcgactaaagctactgtaacagctgaaatcggtaaagttatcccttacgaagttaaaacaaaagttcttaaaggttctaaatacgaaaaactggtttggaccgataccatgtcaaatggtttgacaatgggtgatgatgttaaccttgcagtttcagggactacaacaactttcattaaagatatagattacactcttagcattgatgaccgtggtttcacattgaaattcaaagctactggattggacaaattggaagaagcagctaaagcatctgatgttgaatttacattgacttataaagctactgttaatggccaagcaattattgacaacccagaagtcaatgacatcaaattggactatggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttataca

SEQ ID NO: 169 - DNA, 930 bp, Streptococcus agalactiae
ggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaatgggttgtagataaaaacgctgcaaacgttgttaaattgatttctaatacagctggtaaatttgaaattacaggtttgaatgcaggcgagtatagtttggaagagactcaagcaccaacaggttatgctaaattgtcaagtgatgtatcatttaaagtaaatgatacatcgtatagcgaaggggcttcaaatgatattgcatacgataaagactccggtaaaacagatgcacaaaaagttgtcaacaaaaaagtaaca

SEQ ID NO: 170 - DNA, 672 bp, Streptococcus agalactiae
ggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaa

SEQ ID NO: 171 - DNA, 1458 bp, Streptococcus agalactiae
ggtggggccatcttggctgattcaaaagcggttccagtgaaaatcactcttccattgataaacaaggatggtgttgttaaagatgcacacgtctatccaaagaacactgaaacaaaaccgcaaattgacaagaactttgctgataaaaatcttgattatattaacaaccaaaaagacaaaggtactatatcagcaactgttggtgatgttaaaaaatatactgttgggacaaaaatccttaaaggatctgactataaaaaattagtttggaccgatagcatgacgaaaggattgacgtttaacaacgatgttactgtaacattggatggtgcaaattttgaacaatcaaattacaccttagtagctgatgaccaaggtttccgtcttgtcttgaatgcaacaggtctttctaaagtagcagaagctgcaaaaacaaaagatgttgaaatcaaaatcaactattcagctacagtaaacggttctactgtcgttgaaaagtcagaaaataatgatgtcaaactagattatggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaatgggttgtagataaaaacgctgcaaacgttgttaaattgatttctaatacagctggtaaatttgaaattacaggtttgaatgcaggcgagtatagtttggaagagactcaagcaccaacaggttatgctaaattgtcaagtgatgtatcatttaaagtaaatgatacatcgtatagcgaaggggcttcaaatgatattgcatacgataaagactccggtaaaacagatgcacaaaaagttgtcaacaaaaaagtaaca

SEQ ID NO: 172 - DNA, 1200 bp, Streptococcus agalactiae
ggtggggccatcttggctgattcaaaagcggttccagtgaaaatcactcttccattgataaacaaggatggtgttgttaaagatgcacacgtctatccaaagaacactgaaacaaaaccgcaaattgacaagaactttgctgataaaaatcttgattatattaacaaccaaaaagacaaaggtactatatcagcaactgttggtgatgttaaaaaatatactgttgggacaaaaatccttaaaggatctgactataaaaaattagtttggaccgatagcatgacgaaaggattgacgtttaacaacgatgttactgtaacattggatggtgcaaattttgaacaatcaaattacaccttagtagctgatgaccaaggtttccgtcttgtcttgaatgcaacaggtctttctaaagtagcagaagctgcaaaaacaaaagatgttgaaatcaaaatcaactattcagctacagtaaacggttctactgtcgttgaaaagtcagaaaataatgatgtcaaactagattatggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaa

SEQ ID NO: 173 - DNA, 927 bp, Streptococcus agalactiae
ggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatagcttggaagaaactcaagcaccagcaggttatgcgacattgtcaggtgatgtaaactttgaagtaactgccacatcatatagcaaaggggctacaactgacatcgcatatgataaaggatctgtaaaaaaagatgcccaacaagttcaaaacaaaaaagtaacc

SEQ ID NO: 174 - DNA, 669 bp, Streptococcus agalactiae
ggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaa

SEQ ID NO: 175 - DNA, 1455 bp, Streptococcus agalactiae
aacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtaaagattttcctgttttaaactacaaactcgtaacagatgaccaaggtttccgtcttgccttgaatgcaacaggtcttgcagcagtagcagctgctgcaaaagacaaagatgttgaaatcaagatcacttactcagctacggtgaacggctccactactgttgaagttccagaaaccaatgatgttaaattggactatggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatagcttggaagaaactcaagcaccagcaggttatgcgacattgtcaggtgatgtaaactttgaagtaactgccacatcatatagcaaaggggctacaactgacatcgcatatgataaaggatctgtaaaaaaagatgcccaacaagttcaaaacaaaaaagtaacc

SEQ ID NO: 176 - DNA, 1197 bp, Streptococcus agalactiae
aacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtaaagattttcctgttttaaactacaaactcgtaacagatgaccaaggtttccgtcttgccttgaatgcaacaggtcttgcagcagtagcagctgctgcaaaagacaaagatgttgaaatcaagatcacttactcagctacggtgaacggctccactactgttgaagttccagaaaccaatgatgttaaattggactatggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaa

SEQ ID NO: 177 - protein, 554 aa, Streptococcus agalactiae
MKLSKKLLFSAAVLTMVAGSTVEPVAQFATGMSIVRAAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPSIPNTGGIGTAIFVAIGAAVMAFAVKGMKRRTKDN

SEQ ID NO: 178 - protein, 517 aa, Streptococcus agalactiae
AEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPSIPNTGGIGTAIFVAIGAAVMAFAVKGMKRRTKDN

SEQ ID NO: 179 - protein, 525 aa, Streptococcus agalactiae
MKLSKKLLFSAAVLTMVAGSTVEPVAQFATGMSIVRAAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPSIPNTG

SEQ ID NO: 180 - protein, 520 aa, Streptococcus agalactiae
MKLSKKLLFSAAVLTMVAGSTVEPVAQFATGMSIVRAAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 181 - protein, 483 aa, Streptococcus agalactiae
AEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 182 - protein, 271 aa, Streptococcus agalactiae
AEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKG

SEQ ID NO: 183 - protein, 901 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKGILSFILIGGAMMSIAGGIYIWKRYKKSSDMSIKKD

SEQ ID NO: 184 - protein, 869 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKGILS

SEQ ID NO: 185 - protein, 858 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGI

SEQ ID NO: 186 - protein, 398 aa, Streptococcus agalactiae
TIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNG

SEQ ID NO: 187 - protein, 251 aa, Streptococcus agalactiae
QTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKG

SEQ ID NO: 188 - protein, 896 aa, Streptococcus agalactiae
MRKYQKFSKILTLSLFCLSQIPLNTNVLGESTVPENGAKGKLVVKKTDDQNKPLSKATFVLKPTSHSESKVEKVTTEVTGEATFDNLTPGDYTLSEETAPEGYKKTTQTWQVKVESNGKTTIQNSDDKKSIIEQRQEELDKQYPLTGAYEDTKESYNLEHVKNSIPNGKLEAKAVNPYSSEGEHIREIQEGTLSKRISEVNDLDHNKYKIELTVSGKSIIKTINKDEPLDVVFVLDNSNSMKNNGKNNKAKKAGEAVETIIKDVLGANVENRAALVTYGSDIFDGRTVKVIKGFKEDPYYGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVKGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSDGEITELMNSFSSKPEYYTPIVTSADVSNNEILSKIQQQFEKILTKENSIVNGTIEDPMGDKINLHLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEEPDTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGAMMSIAGGIYIWKRHKKSSDASIEKD

SEQ ID NO: 189 - protein, 393 aa, Streptococcus agalactiae
SIIKTINKDEPLDVVFVLDNSNSMKNNGKNNKAKKAGEAVETIIKDVLGANVENRAALVTYGSDIFDGRTVKVIKGFKEDPYYGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVKGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSDGEITELMNSFSSKPEYYTPIVTSADVSNNEILSKIQQQFEKILTKENSIVNGTIEDPMGDKINLHLGNG

SEQ ID NO: 190 - protein, 251 aa, Streptococcus agalactiae
QTLQPSDYTLQGNDGSIMKDSIATGGPNNDGGILKGVKLEYIKNKLYVRGLNLGEGQKVTLTYDVKLDDSFISNKFYDTNGRTTLNPKSEEPDTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKG

SEQ ID NO: 191 - protein, 901 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTFYRNGPVREHGTPTKLYINSLKQKNYDIFNFGIDISGFRQVYNEDYKKNQDGTFQKLKEEAFELSDGEITELMKSFSSKPEYYTPIVTSSDASNNEILSKIQQQFEKILTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEDPNTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGSMMSIAGGIYIWKRYKKSSDISREKD

SEQ ID NO: 192 - protein, 398 aa, Streptococcus agalactiae
TIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTFYRNGPVREHGTPTKLYINSLKQKNYDIFNFGIDISGFRQVYNEDYKKNQDGTFQKLKEEAFELSDGEITELMKSFSSKPEYYTPIVTSSDASNNEILSKIQQQFEKILTKENSIVNGTIEDPMGDKINLQLGNG

SEQ ID NO: 193 - protein, 251 aa, Streptococcus agalactiae
QTLQPSDYTLQGNDGSIMKDSIATGGPNNDGGILKGVKLEYIKNKLYVRGLNLGEGQKVTLTYDVKLDDSFISNKFYDTNGRTTLNPKSEDPNTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKG

SEQ ID NO: 194 - protein, 901 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPDDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQILQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPKTGGKGILSFILIGGAMMSIAGGIYIWKRYKKSSDMSIKKD

SEQ ID NO: 195 - protein, 398 aa, Streptococcus agalactiae
TIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPDDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNG

SEQ ID NO: 196 - protein, 251 aa, Streptococcus agalactiae
QILQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPKTGGKG

SEQ ID NO: 197 - protein, 901 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNHEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPRAKWGSTTNGLTPEQQKQYYLSKVGETFTMKAFMEADDILSQVDRNSQKIIVHITDGVPTRSYAINNFKLGASYESQFEQMKKNGYLNKSNFLLTDKPEDIKGNGESYFLFPLDSYQTQIISGNLQKLHYLDLNLNYPKGTIYRNGPVREHGTPTKLYINSLKQKNYDIFNFGIDISAFRQVYNEDYKKNQDGTFQKLKEEAFELSDGEITELMKSFSSKPEYYTPIVTSSDASNNEILSKIQQQFEKVLTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEDPNTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGSMMSIAGGIYIWKRYKKSSDISREKD

SEQ ID NO: 198 - protein, 398 aa, Streptococcus agalactiae
TIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPRAKWGSTTNGLTPEQQKQYYLSKVGETFTMKAFMEADDILSQVDRNSQKIIVHITDGVPTRSYAINNFKLGASYESQFEQMKKNGYLNKSNFLLTDKPEDIKGNGESYFLFPLDSYQTQIISGNLQKLHYLDLNLNYPKGTIYRNGPVREHGTPTKLYINSLKQKNYDIFNFGIDISAFRQVYNEDYKKNQDGTFQKLKEEAFELSDGEITELMKSFSSKPEYYTPIVTSSDASNNEILSKIQQQFEKVLTKENSIVNGTIEDPMGDKINLQLGNG

SEQ ID NO: 199 - protein, 251 aa, Streptococcus agalactiae; identical to SEQ ID NO: 193

SEQ ID NO: 200 - protein, 896 aa, Streptococcus agalactiae
MRKYQKFSKILTLSLFCLSQIPLNTNVLGESTVPENGAKGKLVVKKTDDQNKPLSKATFVLKPTSHSESKVEKVTTEVTGEATFDNLTPGDYTLSEETAPEGYKKTTQTWQVKVESNGKTTIQNSDDKKSIIEQRQEELDKQYPLTGAYEDTKESYNLEHVKNSIPNGKLEAKAVNPYSSEGEHIREIQEGTLSKRISEVNDLDHNKYKIELTVSGKSIIKTINKDEPLDVVFVLDNSNSMKNNGKNNKAKKAGEAVETIIKDVLGANVENRAALVTYGSDIFDGRTVKVIKGFKEDPYYGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVTGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSDGEITELMNSFSSKPEYYTPIVTSADVSNNEILSKIQQQFEKILTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEEPDTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGAMMSIAGGIYIWKRHKKSSDASIEKD

SEQ ID NO: 201 - protein, 393 aa, Streptococcus agalactiae
SIIKTINKDEPLDVVFVLDNSNSMKNNGKNNKAKKAGEAVETIIKDVLGANVENRAALVTYGSDIFDGRTVKVIKGFKEDPYYGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVTGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSDGEITELMNSFSSKPEYYTPIVTSADVSNNEILSKIQQQFEKILTKENSIVNGTIEDPMGDKINLQLGNG

SEQ ID NO: 202 - protein, 251 aa, Streptococcus agalactiae; identical to SEQ ID NO: 190

SEQ ID NO: 203 - protein, 896 aa, Streptococcus agalactiae
MRKYQKFSKILTLSLFCLSQIPLNTNVLGESTVPENGAKGKLVVKKTDDQNKPLSKATFVLKTTAHPESKIEKVTAEVTGEATFDNLTPGDYTLSEETAPEGYKKTTQTWQVKVESNGKTTIQNSDDKKSIIEQRQEELDKQYPLTGAYEDTKESYNLEHVKNSIPNGKLEAKAVNPYSSEGEHIREIQEGTLSKRISEVNDLDHNKYKIELTVSGKSIIKTINKDEPLDVVFVLDNSNSMKNNGKNNKAKKAGEAVETIIKDVLGANVENRAALVTYGSDIFDGRTVKVIKGFKEDPYHGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVTGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSGGEITELMKSFSSKPEYYTPIVTSADVSNNEILSKIQQQFEKILTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEEPDTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGAMMSIAGGIYIWKKHKKSSDASIEKD

SEQ ID NO: 204 - protein, 393 aa, Streptococcus agalactiae
SIIKTINKDEPLDVVFVLDNSNSMKNNGKNNKAKKAGEAVETIIKDVLGANVENRAALVTYGSDIFDGRTVKVIKGFKEDPYHGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVTGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSGGEITELMKSFSSKPEYYTPIVTSADVSNNEILSKIQQQFEKILTKENSIVNGTIEDPMGDKINLQLGNG

SEQ ID NO: 205 - protein, 251 aa, Streptococcus agalactiae; identical to SEQ ID NO: 190

SEQ ID NO: 206 - protein, 502 aa, Streptococcus agalactiae
MKKKMIQSLLVASLAFGMAVSPVTPIAFAAETGTITVQDTQKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTELPSTGGIGTTIFYIIGAILVIGAGIVLVARRRLRS

SEQ ID NO: 207 - protein, 437 aa, Streptococcus agalactiae
ETGTITVQDTQKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTE

SEQ ID NO: 208 - protein, 437 aa, Streptococcus agalactiae
ETGTITVQDTKKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTE

SEQ ID NO: 209 - protein, 941 aa, Streptococcus agalactiae
MASAETGTITVQDTQKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTEGGGGSGGGGSGGGGSELAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 210 - protein, 932 aa, Streptococcus agalactiae
MASAETGTITVQDTQKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTEGSGGGGELAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 211 - protein, 941 aa, Streptococcus agalactiae
MASAETGTITVQDTKKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTEGGGGSGGGGSGGGGSELAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 212 - protein, 931 aa, Streptococcus agalactiae
MASAETGTITVQDTKKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTEGSGGGGELAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 213 - protein, 890 aa, Streptococcus agalactiae
MKKRQKIWRGLSVTLLILSQIPFGILVQGETQDTNQALGKVIVKKTGDNATPLGKATFVLKNDNDKSETSHETVEGSGEATFENIKPGDYTLREETAPIGYKKTDKTWKVKVADNGATIIEGMDADKAEKRKEVLNAQYPKSAIYEDTKENYPLVNVEGSKVGEQYKALNPINGKDGRREIAEGWLSKKITGVNDLDKNKYKIELTVEGKTTVETKELNQPLDVVVLLDNSNSMNNERANNSQRALKAGEAVEKLIDKITSNKDNRVALVTYASTIFDGTEATVSKGVADQNGKALNDSVSWDYHKTTFTATTHNYSYLNLTNDANEVNILKSRIPKEAEHINGDRTLYQFGATFTQKALMKANEILETQSSNARKKLIFHVTDGVPTMSYAINFNPYISTSYQNQFNSFLNKIPDRSGILQEDFIINGDDYQIVKGDGESFKLFSDRKVPVTGGTTQAAYRVPQNQLSVMSNEGYAINSGYIYLYWRDYNWVYPFDPKTKKVSATKQIKTHGEPTTLYFNGNIRPKGYDIFTVGIGVNGDPGATPLEAEKFMQSISSKTENYTNVDDTNKIYDELNKYFKTIVEEKHSIVDGNVTDPMGEMIEFQLKNGQSFTHDDYVLVGNDGSQLKNGVALGGPNSDGGILKDVTVTYDKTSQTIKINHLNLGSGQKVVLTYDVRLKDNYISNKFYNTNNRTTLSPKSEKEPNTIRDFPIPKIRDVREFPVLTISNQKKMGEVEFIKVNKDKHSESLLGAKFQLQIEKDFSGYKQFVPEGSDVTTKNDGKIYFKALQDGNYKLYEISSPDGYIEVKTKPVVTFTIQNGEVTNLKADPNANKNQIGYLEGNGKHLITNTPKRPPGVFPKTGGIGTIVYILVGSTFMILTICSFRRKQL

SEQ ID NO: 214 - protein, 1434 aa, Streptococcus agalactiae
MLKKCQTFIIESLKKKKHPKEWKIIMWSLMILTTFLTTYFLILPAITVEETKTDDVGITLENKNSSQVTSSTSSSQSSVEQSKPQTPASSVTETSSSEEAAYREEPLMFRGADYTVTVTLTKEAKIPKNADLKVTELKDNSATFKDYKKKALTEVAKQDSEIKNFKLYDITIESNGKEAEPQAPVKVEVNYDKPLEASDENLKVVHFKDDGQTEVLKSKDTAETKNTSSDVAFKTDSFSIYAIVQEDNTEVPRLTYHFQNNDGTDYDFLTASGMQVHHQIIKDGESLGEVGIPTIKAGEHFNGWYTYDPTTGKYGDPVKFGEPITVTETKEICVRPFMSKVATVTLYDDSAGKSILERYQVPLDSSGNGTADLSSFKVSPPTSTLLFVGWSKTQNGAPLSESEIQALPVSSDISLYPVFKESYGVEFNTGDLSTGVTYIAPRRVLTGQPASTIKPNDPTRPGYTFAGWYTAASGGAAFDFNQVLTKDTTLYAHWSPAQTTYTINYWQQSATDNKNATDAQKTYEYAGQVTRSGLSLSNQTLTQQDINDKLPTGFKVNNTRTETSVMIKDDGSSVVNVYYDRKLITIKFAKYGGYSLPEYYYSYNWSSDADTYTGLYGTTLAANGYQWKTGAWGYLANVGNNQVGTYGMSYLGEFILPNDTVDSDVIKLFPKGNIVQTYRFFKQGLDGTYSLADTGGGAGADEFTFTEKYLGFNVKYYQRLYPDNYLFDQYASQTSAGVKVPISDEYYDRYGAYHKDYLNLVVWYERNSYKIKYLDPLDNTELPNFPVKDVLYEQNLSSYAPDTTTVQPKPSRPGYVWDGKWYKDQAQTQVFDFNTTMPPHDVKVYAGWQKVTYRVNIDPNGGRLSKTDDTYLDLHYGDRIPDYTDITRDYIQDPSGTYYYKYDSRDKDPDSTKDAYYTTDTSLSNVDTTTKYKYVKDAYKLVGWYYVNPDGSIRPYNFSGAVTQDINLRAIWRKAGDYHIIYSNDAVGTDGKPALDASGQQLQTSNEPTDPDSYDDGSHSALLRRPTMPDGYRFRGWWYNGKIYNPYDSIDIDAHLADANKNITIKPVIIPVGDIKLEDTSIKYNGNGGTRVENGNVVTQVETPRMELNSTTTIPENQYFTRTGYNLIGWHHDKDLADTGRVEFTAGQSIGIDNNPDATNTLYAVWQPKEYTVRVSKTVVGLDEDKTKDFLFNPSETLQQENFPLRDGQTKEFKVPYGTSISIDEQAYDEFKVSESITEKNLATGEADKTYDATGLQSLTVSGDVDISFTNTRIKQKVRLQKVNVENDNNFLAGAVFDIYESDANGNKASHPMYSGLVTNDKGLLLVDANNYLSLPVGKYYLTETKAPPGYLLPKNDISVLVISTGVTFEQNGNNATPIKENLVDGSTVYTFKITNSKGTELPSTGGIGTHIYILVGLALALPSGLILYYRKKI

SEQ ID NO: 215 - protein, 478 aa, Streptococcus agalactiae
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPDVKPEAKPDVKPEAKPDVKPEAKPDVKPEAKPDVKPEAKPDVKIVSLIVMLSAGLITIVLKHKKN

SEQ ID NO: 216 - protein, 370 aa, Streptococcus agalactiae
TSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPE

SEQ ID NO: 217 - protein, 411 aa, Streptococcus agalactiae
TSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKLEAKPEAKPATKKSVNTSGNLAAKKAIENKKYSKK

SEQ ID NO: 218 - protein, 436 aa, Streptococcus agalactiae
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPDVKPEAKPDVKPEAKPDVKPEAK

SEQ ID NO: 219 - protein, 364 aa, Streptococcus agalactiae
TSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKK

SEQ ID NO: 220 - protein, 518 aa, Streptococcus agalactiae
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPDVKPEAKPDVKPEAKPDVKPEAKPDVKPEAKPDVKPEAKPDVKEAKPDVKPEAKPEAKPEAKSEAKPEAKLEAKPEAKPATKKSVNTSGNLAAKKAIENKKYSKK

SEQ ID NO: 221 - protein, 378 aa, Streptococcus agalactiae
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKNA

SEQ ID NO: 222 - protein, 471 aa, Streptococcus agalactiae
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKAKHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKNA

SEQ ID NO: 223 - protein, 522 aa, Streptococcus agalactiae
MNNNEKKVKYFLRKTAYGLASMSAAFIVCSGIVNTPTVSADSPDTLKVEKLGKLKDVKSVHELTPISIPNELKGAKEQALSSIISHPNITNSEVDKLASDYSFRINTSNDVNDVKRLLNEFYNAVARKQLDTNSADYRSKIDNISTTGLAIALEAKEIYEANKSILPHRYKDSVGTYVNSFEERRSPGKFNIWNGQEGFNAAQKLLEDVKKLLLELQNLTKNNKPNIQVPKQAPTEAAKPALSPEALTRLTTWYNQAKDLLKDDQVKDKYVDILSVQKAVDQAYDHVEEGKFITTDQANQLANKLRDALQSLELKDKKVAKPVAKGTYDVKYVDTEGKEVAKSRHFEGEEGAAFVTSAKEVAGYKLVRTEGAVSNVFTAGAQVRTYVYEKVKPEVKPDVKPEAKPEAKPEVKPDVKPEAKPEAKPEVKSDVKPEAKPEAKPEAKPEVKPDVKPEAKPEAKPATKKSVNTSGNLVAKKAIENKKYSKKLPSTGEAASPLLAIVSLIVMLSAGLITIVLKHKKN

SEQ ID NO: 224 - protein, 1085 aa, Streptococcus agalactiae
MLKKQFGNFGEKSRKVRVKMRKSGKHWVKSVMTQIGYVILSRFSGKEKSSKVQTTSEDLSRTKTSASILTAVAALGAVVGGTTDTTSVSAEETPTATELTGNEKTLATAETVVVAPEVKTVNSDSSSHSTSESQSMSTSTLQSTSASLSASESLMDSTSASLSESSSLSEYSSLSLSSSESVSASESVQSSEAATTARVQPRAMRVVSSASDMETLPAALISGEGDVTTVQGQDVTDKLQNLDIKLSGGVQAKAGVINMDKSESMHMSLKFTIDSVNRGDTFEIKLSDNIDTNGASNYSIVEPIKSPTGEVYATGIYDSQKKSIVYSFTDFAASKNNINGILDIPLWPDDTTVQNTKEDVLFSVKIKDQEATIKETVKYDPPVRIDFAGGVSVDSRITNIDDVGKKMTYISQINVDGKSLYNYNGLYTRIYNYSKESTADLKNSTIKIYKTTSDNIVESMVQDYSSMEDVTSKFANSYPEKGWYDIYWGQFIASNETYVIVVETPFTNAVTLNTTLSDYNENNGVEHNHTYSSESGYSDVNAQERKILSELVSSSESVSSSESVSNSESISTSESVSNSESISSSESVSSSESISTSESVSTSESISSSESVSSSESVSSSESISSSESVSNSESISSSESVSNSESISSSESVSSSESISNSESISSSESVSTSESISSSESVSNSESISSSESVSSSESVSTSESISSSESVSNSESISTSESVSTSESISSSESVSSSESISSSESVSNSESISNSESVSSSESVSNSESISSSESVSNSESISTSESVSTSESISSSESVSNSESISSSESVSNSESISSSESVSNSESISSSESVSNSESISSSESVSSSESVSSSESISTSESVSNSESISSSESVSNSESISSSESVSNSESISSSESVSNSESISSSESVSSSESISSSESVSSSESVSNSESISSSESVSNSESISSSESVSSSESISSSESVSNSESILSSESVSSSESISSSESISSSESVSMSTTESLSESEVSGDSEISSSTESSSQSESMNHTEIKSDSESQHEVKHQVLPETGDNSASALGLLGAGLLLGATKSRKKKKD

SEQ ID NO: 225 - protein, 1233 aa, Streptococcus agalactiae
MDKHHSKKAILKLTLITTSILLMHSNQVNAEEQELKNQEQSPVIANVAQQPSPSVTTNTVEKTSVTAASASNTAKEMGDTSVKNDKTEDELLEELSKNLDTSNLGADLEEEYPSKPETTNNKESNVVTNASTAIAQKVPSAYEEVKPESKSSLAVLDTSKITKLQAITQRGKGNVVAIIDTGFDINHDIFRLDSPKDDKHSFKTKTEFEELKAKHNITYGKWVNDKIVFAHNYANNTETVADIAAAMKDGYGSEAKNISHGTHVAGIFVGNSKRPAINGLLLEGAAPNAQVLLMRIPDKIDSDKFGEAYAKAITDAVNLGAKTINMSIGKTADSLIALNDKVKLALKLASEKGVAVVVAAGNEGAFGMDYSKPLSTNPDYGTVNSPAISEDTLSVASYESLKTISEVVETTIEGKLVKLPIVTSKPFDKGKAYDVVYANYGAKKDFEGKDFKGKIALIERGGGLDFMTKITHATNAGVVGIVIFNDQEKRGNFLIPYRELPVGIISKVDGERIKNTSSQLTFNQSFEVVDSQGGNRMLEQSSWGVTAEGAIKPDVTASGFEIYSSTYNNQYQTMSGTSMASPHVAGLMTMLQSHLAEKYKGMNLDSKKLLELSKNILMSSATALYSEEDKAFYSPRQQGAGVVDAEKAIQAQYYITGNDGKAKINLKRMGDKFDITVTIHKLVEGVKELYYQANVATEQVNKGKFALKPQALLDTNWQKVILRDKETQVRFTIDASQFSQKLKEQMANGYFLEGFVRFKEAKDSNQELMSIPFVGFNGDFANLQALETPIYKTLSKGSFYYKPNDTTHKDQLEYNESAPFESNNYTALLTQSASWGYVDYVKNGGELELAPESPKRIILGTFENKVEDKTIHLLERDAANNPYFAISPNKDGNRDEITPQATFLRNVKDISAQVLDQNGNVIWQSKVLPSYRKNFHNNPKQSDGHYRMDALQWSGLDKDGKVVADGFYTYRLRYTPVAEGANSQESDFKVQVSTKSPNLPSRAQFDETNRTLSLAMPKESSYVPTYRLQLVLSHVVKDEEYGDETSYHYFHIDQEGKVTLPKTVKIGESEVAVDPKALTLVVEDKAGNFATVKLSDLLNKAVVSEKENAIVISNSFKYFDNLKKEPMFISKKEKVVNKNLEEIILVKPQTTVTTQSLSKEITKSGNEKVLTSTNNNSSRVAKIISPKHNGDSVNHTLPSTSDRATNGLFVGTLALLSSLLLYLKPKKTKNNSK

SEQ ID NO: 226 - protein, 690 aa, Streptococcus agalactiae
MKKKIILKSSVLGLVAGTSIMFSSVFADQVGVQVIGVNDFHGALDNTGTANMPDGKVANAGTAAQLDAYMDDAQKDFKQTNPNGESIRVQAGDMVGASPANSGLLQDEPTVKNFNAMNVEYGTLGNHEFDEGLAEYNRIVTGKAPAPDSNINNITKSYPHEAAKQEIVVANVIDKVNKQIPYNWKPYAIKNIPVNNKSVNVGFIGIVTKDIPNLVLRKNYEQYEFLDEAETIVKYAKELQAKNVKAIVVLAHVPATSKNDIAEGEAAEMMKKVNQLFPENSVDIVFAGHNHQYTNGLVGKTRIVQALSQGKAYADVRGVLDTDTQDFIETPSAKVIAVAPGKKTGSADIQAIVDQANTIVKQVTEAKIGTAEVSVMITRSVDQDNVSPVGSLITEAQLAIARKSWPDIDFAMTNNGGIRADLLIKPDGTITWGAAQAVQPFGNILQVVEITGRDLYKALNEQYDQKQNFFLQIAGLRYTYTDNKEGGEETPFKVVKAYKSNGEEINPDAKYKLVINDFLFGGGDGFASFRNAKLLGAINPDTEVFMAYITDLEKAGKKVSVPNNKPKIYVTMKMVNETITQNDGTHSIIKKLYLDRQGNIVAQEIVSDTLNQTKSKSTKINPVTTIHKKQLHQFTAINPMRNYGKPSNSTTVKSKQLPKTNSEYGQSFLMSVFGVGLIGIALNTKKKHMK

SEQ ID NO: 227 - protein, 877 aa, Streptococcus agalactiae
MKGQKIIALAGLVLSCHFALTACHTQEHKNSHHIKTKQVAKKKANKKKVSVKESHKKRKGVAGVDFPTDDGFLLTKDSKILSHTDSGIVVAHGNHSHFIFYSDLKGSKFSYLIPNANTKTNKNQAVRNFKAGAVAVNTLNDGYVFNPADIVSEDANGYVVRHGDHFHYIPKASLSQQKQVQASRAVSRLGNQSNSHYRVNSSKIAGLHYPTSNGFLFNGRGIKGTTPTGILVEHHNHLHFISFADLRKGGWGSIADRYQPQKKADSKKQSPSSKKPRTENTLPKDIKDKLAYLARELHLDISRIRVLKTLNGEIGFEYPHDDHTHVIMAKDIDLSKPIPNPHHDDEDHHKGHHHDESDHKHEEHEHTKSNKLSDEDQKKLIYLAEKLGLNPNQIEVLTSEDGSIIFKYPHDDHSHTIASKDIEIGKPIPDGHHDHSHAKDKVGMATLKQIGFDDEIIQDILHADAPTPFPSNETNPEKMRQWLATVTKINIGQRTNPFQRFGLSLMPNIEVLGIGFTPINDMTPVLQFKKLKQLWMTNTGITDYSFLDKMPLLEGLDISQNGIKDLSFLTKYKQLSLIAAANNGITSLKPLAELPNLQFLVLSHNNISDLTPLSNLTKLQELYLDHNNVKNLSALSGKKDLKVLDLSNNKSADLSTLKTTSLETLLLNETNTSNLSFLKQNPKVSNLTINNAKLASLDGIEESDEIVKVEAEGNQIKSLVLKNKQGSLKFLNVTNNQLTSLEGVNNYTSLETLSVSKNKLESLDIKTPNKTVTNLDFSHNNVPTSQLKLNEKNIPEAVAKNFPAVVEGSMVGNGSLAEKAAMASKEDKQVSDNTNHQKNTEKSAQANADSKKENPKTHDEHHDHEETDHAHVGHHHH

SEQ ID NO: 228 - DNA, 28 bp, Artificial Sequence
  source: /note="Description of Artificial Sequence: Synthetic primer"
caccatggaagaagcaaaaactactgac

SEQ ID NO: 229 - DNA, 27 bp, Artificial Sequence
  source: /note="Description of Artificial Sequence: Synthetic primer"
tcattaatcagccaagatagaaccatc

SEQ ID NO: 230 - DNA, 28 bp, Artificial Sequence
  source: /note="Description of Artificial Sequence: Synthetic primer"
caccatggatggttctatcttggctgat

SEQ ID NO: 231 - DNA, 27 bp, Artificial Sequence
  source: /note="Description of Artificial Sequence: Synthetic primer"
tcattattcaattgttgggttgttgcc

SEQ ID NO: 232 - DNA, 28 bp, Artificial Sequence
  source: /note="Description of Artificial Sequence: Synthetic primer"
caccatgggcaacaacccaacaattgaa

SEQ ID NO: 233 - DNA, 27 bp, Artificial Sequence
  source: /note="Description of Artificial Sequence: Synthetic primer"
tcattaagctttttctgcatctgttgc

SEQ ID NO: 234 - DNA, 28 bp, Artificial Sequence
  source: /note="Description of Artificial Sequence: Synthetic primer"
caccatgttggcaggagctaccttcctt

SEQ ID NO: 235 - DNA, 27 bp, Artificial Sequence
  source: /note="Description of Artificial Sequence: Synthetic primer"
tcattaagtaaccttcttattgataac

SEQ ID NO: 236 - DNA, 28 bp, Artificial Sequence
  source: /note="Description of Artificial Sequence: Synthetic primer"
caccatggctgagatgggaaatatcact

SEQ ID NO: 237 - DNA, 27 bp, Artificial Sequence
  source: /note="Description of Artificial Sequence: Synthetic primer"
tcattagtcagcaagaactttgtcacc

SEQ ID NO: 238 - DNA, 28 bp, Artificial Sequence
  source: /note="Description of Artificial Sequence: Synthetic primer"
caccatgggtgacaaagttcttgctgac

SEQ ID NO: 239 - DNA, 30 bp, Artificial Sequence
  source: /note="Description of Artificial Sequence: Synthetic primer"
tcattatacttttttacctggtttgttacc

SEQ ID NO: 240 - DNA, 36 bp, Artificial Sequence
  source: /note="Description of Artificial Sequence: Synthetic primer"
ctgtacttccagggcaacaaaccaggtaaaaaagta

SEQ ID NO: 241 - DNA, 39 bp, Artificial Sequence
  source: /note="Description of Artificial Sequence: Synthetic primer"
aattaagtcgcgttattatgcaccttgcaagcgttctgt

SEQ ID NO: 242 - DNA, 28 bp, Artificial Sequence
  source: /note="Description of Artificial Sequence: Synthetic primer"
caccatgacagaacgcttgcaaggtgca

SEQ ID NO: 243 - DNA, 27 bp, Artificial Sequence
  source: /note="Description of Artificial Sequence: Synthetic primer"
tcattaagtcacttttttgttttctat

SEQ ID NO: 244 - DNA, 34 bp, Artificial Sequence
  source: /note="Description of Artificial Sequence: Synthetic primer"
gtttgcgcatatggctgagatgggaaatatcact

SEQ ID NO: 245 - DNA, 34 bp, Artificial Sequence
  source: /note="Description of Artificial Sequence: Synthetic primer"
gtggaatctcgagagtcacttttttgttttctat

SEQ ID NO: 246 - DNA, 42 bp, Artificial Sequence
  source: /note="Description of Artificial Sequence: Synthetic primer"
ctgtacttccagggcgaagaagcaaaaactactgacacagtg

SEQ ID NO: 247 - DNA, 42 bp, Artificial Sequence
  source: /note="Description of Artificial Sequence: Synthetic primer"
aattaagtcgcgttatgtaccaataccacctgtttgtggaat

SEQ ID NO: 248 - DNA, 37 bp, Artificial Sequence
  source: /note="Description of Artificial Sequence: Synthetic primer"
ctgtacttccagggcaataatccgaccattgaaaatg

SEQ ID NO: 249 - DNA, 39 bp, Artificial Sequence
  source: /note="Description of Artificial Sequence: Synthetic primer"
aattaagtcgcgttaaatcggcgtcggatcgttactgtt

SEQ ID NO: 250 - DNA, 42 bp, Artificial Sequence
  source: /note="Description of Artificial Sequence: Synthetic primer"
cacgctattgtcatgcctcgaactgcatttgacggttttact

SEQ ID NO: 251 - DNA, 42 bp, Artificial Sequence
  source: /note="Description of Artificial Sequence: Synthetic primer"
catgacaatagcgtgcaaggtcactgtgtcagtagtttttgc

SEQ ID NO: 252 - DNA, 36 bp, Artificial Sequence
  source: /note="Description of Artificial Sequence: Synthetic primer"
gaagcggcggaaatcgcaggtgcttactttgctttc

SEQ ID NO: 253 - DNA, 39 bp, Artificial Sequence
  source: /note="Description of Artificial Sequence: Synthetic primer"
gatttccgccgcttcgcctgagccaaagtaagttttaag

SEQ ID NO: 254 - DNA, 28 bp, Artificial Sequence
  source: /note="Description of Artificial Sequence: Synthetic primer"
caccatggacgacgcaacaactgatact

SEQ ID NO: 255 - DNA, 30 bp, Artificial Sequence
  source: /note="Description of Artificial Sequence: Synthetic primer"
tcattatgaatcagccaagatagaaccgtt

SEQ ID NO: 256 - DNA, 31 bp, Artificial Sequence
  source: /note="Description of Artificial Sequence: Synthetic primer"
caccatgaacggttctatcttggctgattca

SEQ ID NO: 257 - DNA, 27 bp, Artificial Sequence
  source: /note="Description of Artificial Sequence: Synthetic primer"
tcattattcttccgttgggttattacc

SEQ ID NO: 258 - DNA, 28 bp, Artificial Sequence
  source: /note="Description of Artificial Sequence: Synthetic primer"
caccatgggtaataacccaacggaagaa

SEQ ID NO: 259 - DNA, 27 bp, Artificial Sequence
  source: /note="Description of Artificial Sequence: Synthetic primer"
tcattaagctcctgccaagcgttcagt

SEQ ID NO: 260 - DNA, 28 bp, Artificial Sequence
  source: /note="Description of Artificial Sequence: Synthetic primer"
caccatgactgaacgcttggcaggagct

SEQ ID NO: 261 - DNA, 30 bp, Artificial Sequence
  source: /note="Description of Artificial Sequence: Synthetic primer"
tcattaggttacttttttgttttgaacttg

SEQ ID NO: 262 - DNA, 460 bp, Mus musculus
atgaacttcgggctgagattgattttccttgccctcattttaaaaggtgtccagtgtgaggtgcagctggtggagtctgggggagactcagtgaagcctggagggtccctgaaactctcctgtgcaacctcaggattcactttcagtagctatggcatgtcttgggtgcgccagactccagacatgaggctggagtggatcacaatcattagtggtgatggttattacacctactatcgagacagtgtgaaggggcggttcaccgtctccagagacaatgccaggaacaccctgtatttgcaaatgaccagtctgaagtctgaggacacagccatgtattactgtgcaagcctgttgggtaactacgctatggactattggggtcaaggaacctcagtcaccgtctccttagccaaaacaacacccccatcagtctatcccctggcccctggaagcttgg

SEQ ID NO: 263 - protein, 153 aa, Mus musculus
MNFGLRLIFLALILKGVQCEVQLVESGGDSVKPGGSLKLSCATSGFTFSSYGMSWVRQTPDMRLEWITIISGDGYYTYYRDSVKGRFTVSRDNARNTLYLQMTSLKSEDTAMYYCASLLGNYAMDYWGQGTSVTVSLAKTTPPSVYPLAPGSL

SEQ ID NO: 264 - DNA, 447 bp, Mus musculus
atgaagttgcctgttaggctgttggtgctgatgttctggattcctgcttccaacagtgatgttttgatgacccaaactccactctccctgcctgtcgggcttggagatcaagtctccatctcttgcagatctggtcagagtcttgaacatagtaatggagacacctatttacaatggtacctacagaaacctggccagtctccaaagctcctgatctacaaagtttccaaccgattttctggggtcccagacaggttcagtggcagtggatcagggacagatttcacactcaagatcagcagagtggaggctgaggatctgggagtttattactgctttcagggttcacatgttcctcccacgttcggaggggggaccaagctggaaataaaacgggctgatgctgcaccaactgtatccatcttcccaccatccagtaagcttggg

SEQ ID NO: 265 - protein, 149 aa, Mus musculus
MKLPVRLLVLMFWIPASNSDVLMTQTPLSLPVGLGDQVSISCRSGQSLEHSNGDTYLQWYLQKPGQSPKLLIYKVSNRFSGVPDRFSGSGSGTDFTLKISRVEAEDLGVYYCFQGSHVPPTFGGGTKLEIKRADAAPTVSIFPPSSKLG

SEQ ID NO: 266 - DNA, 460 bp, Mus musculus
atgaacttcgggctgagattgattttccttgtccttattttaaaaggtgtccagtgtgaagtgcagctggtggagtctgggggaggcttagtgaagcctggagggtccctgaaactctcctgtgcagcctctggattcactttcagtagctatgccatgtcttgggttcgcctgtctccagagacgaggctggagtgggtcgcagaaattagtggtgatggcagttacacctactatccagaccctgtgacgggccgattcaccatctccagagacaatgccaggaacaccctgtacctggaaatgagcagtctgaggtctgaagacacggccatgtattactgtggaagtctgattgggaactatgctatggactactggggtcaaggaacctcagtcaccgtctcctcagccaaaacaacagccccatcggtctatcccctggcccctggaagcttgg

SEQ ID NO: 267 - protein, 153 aa, Mus musculus
MNFGLRLIFLVLILKGVQCEVQLVESGGGLVKPGGSLKLSCAASGFTFSSYAMSWVRLSPETRLEWVAEISGDGSYTYYPDPVTGRFTISRDNARNTLYLEMSSLRSEDTAMYYCGSLIGNYAMDYWGQGTSVTVSSAKTTAPSVYPLAPGSL

SEQ ID NO: 268 - DNA, 456 bp, Mus musculus
tactagtcgacatgaagttgcctgttaggctgttggtgctgatgttctggattcctgcttccagcagtgatgttttgatgacccaaactccactctccctgcctgtcagtcttggagatcaagcctccatctcttgtagatctagtcagagcattgtacatagtaatggagacacctatttagaatggtacctgcagaaaccaggccagtctccaaagctccttatctacaaagtttccaaccgattttctggggtcccagacaggttcagtggcagtggatcagggacagatttcacactcaagatcagcagagtggaggctgaggatctgggagtttattactgctttcaaggttcacatgttccccggacgttcggtggaggcaccaagctggaaatcaaacgggctgatgctgcaccaactgtatccatcttcccaccatccagtaagcttg

SEQ ID NO: 269 - protein, 151 aa, Mus musculus
LVDMKLPVRLLVLMFWIPASSSDVLMTQTPLSLPVSLGDQASISCRSSQSIVHSNGDTYLEWYLQKPGQSPKLLIYKVSNRFSGVPDRFSGSGSGTDFTLKISRVEAEDLGVYYCFQGSHVPRTFGGGTKLEIKRADAAPTVSIFPPSSKL

SEQ ID NO: 270 - protein, 26 aa, Streptococcus agalactiae
TYRVIERVSGYAPEYVSFVNGVVTIK

SEQ ID NO: 271 - protein, 665 aa, Streptococcuspneumoniae
MKSINKFLTMLAALLLTASSLFSAATVFAAGTTTTSVTVHKLLATDGDMDKIANELETGNYAGNKVGVLPANAKEIAGVMFVWTNTNNEIIDENGQTLGVNIDPQTFKLSGAMPATAMKKLTEAEGAKFNTANLPAAKYKIYEIHSLSTYVGEDGATLTGSKAVPIEIELPLNDVVDAHVYPKNTEAKPKIDKDFKGKANPDTPRVDKDTPVNHQVGDVVEYEIVTKIPALANYATANWSDRMTEGLAFNKGTVKVTVDDVALEAGDYALTEVATGFDLKLTDAGLAKVNDQNAEKTVKITYSATLNDKAIVEVPESNDVTFNYGNNPDHGNTPKPNKPNENGDLTLTKTWVDATGAPIPAGAEATFDLVNAQTGKVVQTVTLTTDKNTVTVNGLDKNTEYKFVERSIKGYSADYQEITTAGEIAVKNWKDENPKPLDPTEPKVVTYGKKFVKVNDKDNRLAGAEFVIANADNAGQYLARKADKVSQEEKQLVVTTKDALDRAVAAYNALTAQQQTQQEKEKVDKAQAAYNAAVIAANNAFEWVADKDNENVVKLVSDAQGRFEITGLLAGTYYLEETKQPAGYALLTSRQKFEVTATSYSATGQGIEYTAGSGKDDATKVVNKKITIPQTGGIGTIIFAVAGAAIMGIAVYAYVKNNKDEDQLA

SEQ ID NO: 272 - protein, 6 aa, Artificial Sequence
  source: /note="Description of Artificial Sequence: Synthetic peptide"
GSGGGG

SEQ ID NO: 273 - protein, 8 aa, Artificial Sequence
  source: /note="Description of Artificial Sequence: Synthetic peptide"
GSGSGGGG

SEQ ID NO: 274 - protein, 5 aa, Artificial Sequence
  source: /note="Description of Artificial Sequence: Synthetic peptide"
AAALE

SEQ ID NO: 275 - protein, 6 aa, Artificial Sequence
  source: /note="Description of Artificial Sequence: Synthetic 6xHis tag"
HHHHHH

SEQ ID NO: 276 - protein, 1179 aa, Streptococcus agalactiae
MGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPIGSGSGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLGSGSGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPIGSGSGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLGSGSGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLGSGSGNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPIGSGGGGETGTITVQDTQKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTE

SEQ ID NO: 277 - protein, 4 aa, Artificial Sequence
  source: /note="Description of Artificial Sequence: Synthetic peptide"
GSGS

SEQ ID NO: 278 - DNA, 37 bp, Artificial Sequence; identical to SEQ ID NO: 248
  source: /note="Description of Artificial Sequence: Synthetic primer"

SEQ ID NO: 279 - DNA, 39 bp, Artificial Sequence
  source: /note="Description of Artificial Sequence: Synthetic primer"
aattaagtcgcgttactcagtacctttgttattttcaac

SEQ ID NO: 280 - DNA, 42 bp, Artificial Sequence
  source: /note="Description of Artificial Sequence: Synthetic primer"
ggtagcggtggtggtggtgctgagacagggacaattacagtt

SEQ ID NO: 281 - DNA, 42 bp, Artificial Sequence
  source: /note="Description of Artificial Sequence: Synthetic primer"
accaccaccaccgctaccaatcggcgtcggatcgttactgtt

SEQ ID NO: 282 - DNA, 18 bp, Artificial Sequence
  source: /note="Description of Artificial Sequence: Synthetic oligonucleotide"
ggtagcggtggtggtggt

SEQ ID NO: 283 - DNA, 34 bp, Artificial Sequence
  source: /note="Description of Artificial Sequence: Synthetic primer"
ctagctagcggcaataatccgaccattgaaaatg

SEQ ID NO: 284 - DNA, 36 bp, Artificial Sequence
  source: /note="Description of Artificial Sequence: Synthetic primer"
ccgctcgagttactcagtacctttgttattttcaac

SEQ ID NO: 285 - protein, 282 aa, Artificial Sequence
  source: /note="Description of Artificial Sequence: Synthetic polypeptide"
  source: /note="D2 and D3 domains of GBS1523"
GKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTE

SEQ ID NO: 286 - protein, 293 aa, Artificial Sequence
  source: /note="Description of Artificial Sequence: Synthetic polypeptide"
  source: /note="D2 and D3 domains of GBS1523 with N terminal sequence"
TDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTELE

SEQ ID NO: 287 - protein, 160 aa, Artificial Sequence
  source: /note="Description of Artificial Sequence: Synthetic polypeptide"
  source: /note="Domain 1 of GBS1523"
MASAETGTITVQDTQKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGG

SEQ ID NO: 288 - protein, 176 aa, Artificial Sequence
  source: /note="Description of Artificial Sequence: Synthetic polypeptide"
  source: /note="Domain 1 of GBS1523 Variant sequence"
MKKKMIQSLLVASLAFGMAVSPVTPIAFAAETGTITVQDTQKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKN

SEQ ID NO: 289 - protein, 171 aa, Artificial Sequence
  source: /note="Description of Artificial Sequence: Synthetic polypeptide"
  source: /note="Domain 2 of GBS1523"
KTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIK

SEQ ID NO: 290 - protein, 175 aa, Artificial Sequence
  source: /note="Description of Artificial Sequence: Synthetic polypeptide"
  source: /note="Domain 2 of GBS1523 Variant"
TDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRD

SEQ ID NO: 291 - protein, 110 aa, Artificial Sequence
  source: /note="Description of Artificial Sequence: Synthetic polypeptide"
  source: /note="Domain 3 of GBS1523"
KIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTE

SEQ ID NO: 292 - protein, 151 aa, Artificial Sequence
  source: /note="Description of Artificial Sequence: Synthetic polypeptide"
  source: /note="Domain 3 of GBS1523 Variant sequence"
GQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTELPSTGGIGTTIFYIIGAILVIGAGIVLVARRRLRS

SEQ ID NO: 293 - protein, 1023 aa, Artificial Sequence
  source: /note="Description of Artificial Sequence: Synthetic polypeptide"
  source: /note="GBS59(6xD3)-GBS1523D2+D3 Fusion Protein"
MGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPIGSGSGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLGSGSGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPIGSGSGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLGSGSGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLGSGSGNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPIGSGGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTE

SEQ ID NO: 294 - protein, 1146 aa, Artificial Sequence
  source: /note="Description of Artificial Sequence: Synthetic polypeptide"
  source: /note="GBS59(7xD3SUB)-GBS1523D2+D3 Fusion Protein"
GNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLGSGSGGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPIGSGSGGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPIGSGSGGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLGSGSGGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLGSGSGGNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPIGSGSGGNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPIGGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTE

SEQ ID NO: 295 - protein, 10 aa, Artificial Sequence
  source: /note="Description of Artificial Sequence: Synthetic peptide"
  VARIANT (3)..(10): /replace=" "
  misc_feature (1)..(10): /note="Variant residues given in the sequence have no preference with respect to those in the annotations for variant positions"
GGGGGGGGGG

SEQ ID NO: 296 - protein, 10 aa, Artificial Sequence
  source: /note="Description of Artificial Sequence: Synthetic peptide"
  VARIANT (4)..(10): /replace=" "
  misc_feature (1)..(10): /note="Variant residues given in the sequence have no preference with respect to those in the annotations for variant positions"
HHHHHHHHHH

SEQ ID NO: 297 - protein, 4 aa, Artificial Sequence
  source: /note="Description of Artificial Sequence: Synthetic peptide"
GGGG

SEQ ID NO: 298 - protein, 7 aa, Artificial Sequence
  source: /note="Description of Artificial Sequence: Synthetic peptide"
GSGSSSS

The invention claimed is:

1. A conjugate comprising an antigen and a carrier molecule, wherein the carrier molecule comprises BP-2a polypeptides derived from different *Streptococcus agalactiae* strains and a *Streptococcus agalactiae* spb1 polypeptide as a single polypeptide chain, said polypeptide chain having an amino acid sequence at least 70% identity to SEQ ID NO:276.

2. The conjugate according to claim 1, wherein the spb1 polypeptide comprises a sequence selected from the group consisting of:
   (a) the amino acid sequence of SEQ ID NO:206; and
   (b) a fragment of SEQ ID NO:206 comprising amino acids 185 to 468.

3. The conjugate according to claim 1, wherein the carrier molecule comprises a BP-2a polypeptide having an amino acid sequence selected from the group consisting of SEQ ID NO:36, SEQ ID NO:38, SEQ ID NO:40, SEQ ID NO:42, SEQ ID NO:44, and SEQ ID NO:46.

4. The conjugate according to claim 1, wherein said BP-2a polypeptides are separated by a linker amino acid sequence.

5. The conjugate according to claim 1, wherein the antigen is a saccharide.

6. The conjugate according to claim 5, wherein the saccharide is a capsular saccharide from *Streptococcus agalactiae*.

7. The conjugate according to claim 6, wherein the saccharide is a capsular saccharide from *Streptococcus agalactiae* serotype II or V.

8. A pharmaceutical composition comprising a conjugate according to claim 1 in combination with a pharmaceutically acceptable carrier.

9. The pharmaceutical composition according to claim 8, comprising a mixture of conjugates comprising saccharides from at least two of *Streptococcus agalactiae* serotypes selected from the group consisting of types Ia, Ib, II, III and V.

10. A method for raising an immune response in a mammal, comprising administering an immunologically effective amount of a conjugate according to claim 1 to the mammal.

11. A conjugate comprising an antigen and a carrier molecule, wherein the carrier molecule comprises an amino acid sequence having SEQ ID NO:276.

12. A method for raising an immune response in a mammal, comprising administering an immunologically effective amount of a pharmaceutical composition according to claim 8 to the mammal.

13. The conjugate according to claim 11, wherein the antigen is a saccharide.

14. The conjugate according to claim 13, wherein the saccharide is a capsular saccharide from *Streptococcus agalactiae*.

15. The conjugate according to claim 14, wherein the saccharide is a capsular saccharide from *Streptococcus agalactiae* serotype II or V.

16. A pharmaceutical composition comprising a conjugate according to claim 11 in combination with a pharmaceutically acceptable carrier.

17. The pharmaceutical composition according to claim 16, comprising a mixture of conjugates comprising saccharides from at least two of *Streptococcus agalactiae* serotypes selected from the group consisting of types Ia, Ib, II, III and V.

18. A method for raising an immune response in a mammal, comprising administering an immunologically effective amount of a conjugate according to claim 11 to the mammal.

* * * * *